United States Patent 12,790,634 (MOST PROBABLE NUMBER ANALYSIS OF HETEROGENOUS POPULATIONS) - sequence listing, part 44

SEQ ID NO: 29 - DNA, 7559983 bp, unidentified (residues 1,889,997-3,779,992 of 7,559,983)
  source 1..7559983: mol_type = genomic DNA; note = Eisenbergiella tayi
gcagtcatgatgtttttctgcttttttgattatacgagaattggcttatggggaaagacaggggcggcggtattgctgctgcttttactatatagctatttcggcggcctggcagtatacggacagcggggttatctgcgtgtcggaggattgtctgtcagtctgcatcagctgatatatctgtatattcctttttacggaggaattttatactcctacaaaaatcagggcagaaaaggatttacaaaaagtatggtgtggagcgtgctccctgtcattctcgtcttaaaattgccggacttatccacagcgggttcactgatgttaattatgctgattcaggtttgtttcattaccagaaaaggatggtttggcgaatggaagaaaaaactggcatttgttgtttcagcaatgatcggactgcctgttttcctggttctgtattttgttttctttggggcagaatatcaaaaagcccgtttgttttccgtttttaacacagcaggggatcagaactatcagataaatatggccagaaacctgataagcggcagcaaatggataggggaaggcaggctgaatgcaaaaggttttcttccggcggcagcaagtgattatattgtgacttatgttatgtcttattatggaatactggctgtaattgtactgctggcagttttggggcttttcatctttaaaaccttcaagatcagcgttcatcagaaaaaccagctgggaaccgtgatcggagtcggatgcagtctggtatttatgatacagattgttttatatgtcatggtaaatcttacgattttcccttccaccgcagtattccttcccttatttacctacggcggaaccggtaccattgtttcctttgctttaattggaattctgctcagcatctatcgatatcagaatgtgctgccggttcatatggtgagaaagcagaaggtgaaactgggattgtaactgattaaggacagaggattcatttatcctttgagtatcaggaggaacaaaaattggaaatcagagaataccggccggaagactgcagtgagatggcctcacttttttatgataccgtacatacggtaaatgcggccgattatacaaaggaacagctggatgcctgggcggatggggcagtggattgtgaggcatgggatcattccttccgggagcattatacgctggtggctatagaggatggtaagctggcagggtttggcgacatggatgagagcggatatcttgaccggctttatatacataaggactttcagaaaaaaggaatagccgccgccttgtgcgaccggctggagaagcggtttgccgtgcctgagatcgtaacccatgcatccattacggcaaggcccttttttgaaaaaagagggtaccgtgtgcggaaggcgcagcaggtggaaaggaagggagtccttctaaccaattatgtaatggcgctttcgaaggccggacaaaaatgagcaaggcagtcagggacagccatataaaaaagccttacaatgggaacacgaggtgagagaaaatggattgtattcagagcatacagaaagcaatagactatatggaagccaatatgctggaaaacatcagctatgaagatgcggcacggcatctgcatatgtcaaattatcatttccatcggttgttcagcatgctgacagggatgacggcaaatgagtatatccgcagccggaggctgtccatggcagggcaggaactgattatgtccgatgcgaagattattgatatcgctttgaagtacggctatgattcaccggacggttttgccaaggctttttacaggtttcacggagtgacacctaatatggcaaagcagccgggggccggattacagttgtttaaccgcctcgtaataaatattacatggaaaggcggtatggttatggagtacaggattgtagaaagagaaaaatttaaggttcttgcaaaggttgagcaatttcgcaacagctctattgacgaggaagggaatacggagattccggatttctggaagaagtgcggtgaagagggcgtttttgacacgctgacggcctgcaccggcaaaggggatatttacggggtctgcgggccagtctccagggaatgtgatttctttagctatgggataggcaaggagtatgaaggcggcgatgttccggacggattttgtgtatgggagattaaccctaccctctgggcggtcttttcctgtatcggaaaggacggggactgtattggtgaaacctgggatcggatttttaaggagtttttaccgggttccgactataatatgaaagatgacgatgattttgaattatatttggaaaatcccgctcctggctgcttctgtgaaatatggatcccggtggagaagaaatagtccggatattgtgcgcattcgcagcttatttcttataaacaaaaaaatctttgacggataaggatttagtgatataataagtttcaatggattaaatcagtaaagtttataacgaaggagtgagctgcgatggaaaagaaaaatattgattgggccaatctgggatttggttatcgtgtgactgatgtacgttacgtttccaatttcaggaatggcgcatgggatgaaggagtgctgacagaggatgccacgatccagctgaatgaatgtgcgggaatcctgcagtactgccaggaaatatttgaaggactgaaggcatataccacagaggacggacatattgttactttccgccctgatctgaatgcagaacgtatgatggacagtgccaaacgtctggaaatgccggctttccccaaggaaaggttcctggatgccatcgataaggtcgtaacagccaacgcagcatgggttcccccttatggaagcggggccactctttatattcgtccttatatgttcgcaagctcaccggttatcggggttaagcctgcggaggaatatcagttccgtgtattcgttacgccggtaggcccttattttaagggaggcgcaaagcccttaactctgtgtgtcagcgattttgacagagcggcgccccatggtacaggccatatcaaggcaggcctgaattatgccatgagcttacatgcaggcgttaccgcccatgccaacggatttgatgaaaacctgttcctggatcctgctacgagaacctatgtggaggagacaggcggggccaacttcctgtttgtagacaagaacgggacaatcatcactcccaaatccgaaagcatccttccttccataacaaggcgttcccttgtaacggtagcaagagatattttaggtatggaagtacaggaacgtcctgtgaagctggaggaactgaaagacttcgcggaatgcggcctctgcggtacggcggcggttatcagccctgtgggaaaagttgtggatcacggcaaagatatctgctttgccagcggtatggaggagatggggccggttatcaagaagctgtatgataccctcaccggaatccagatgggaagaattgaagggccggaaggctgggtaagaacgattctgtaaaataagtaaataaatatataaaacactgcctggcttttaaaagtgggcagtgtttttttacggatggaaaaaaagcgggagtatgatatactgaaacaggtgagaaatgcatcggtaactacagaaaaaggagaattacaatcatgtcaaaatggacggtagaatcaataaaggaagcctatccttatttatatgaaacacatcttcatacctctcagagcagcctctgcggcagggcggagggacgggagatggcggatgcctgcaaaaaggcgggctataccggtatctttgtgacggatcacaactggggaggaaatacggcggcggagcggtcgcttccctgggaaacatgggtgtcggaatttgcaaaaggctacctggatgcaaaagaagaaggggaacggattggcctggatgttttctttggctgggaggccggctttcagggaaccgagttccttattttcggcctgtccccggagtggctgaccgcccatccggaaatccgggaagcgggagttgaggagcagtaccgtcttgtgaaggcagacggagggatggtgatccatgcccatccgttccgtgaggaagcgtatattcccgaaatcaggctttttccggaattcgtggacggagcggagggaatgaatgcgacgcatacaagccctcttagtgcatcccacaagagcggagattatgacagaaaggcccggacttatgcaaaggaacatgggctggtgatgacggcaggatcagacgtgcacagcaccaatattttcgggggaggcaccgccttcgcgcgaaagctgtcggacgataaagattttatacaggcaattcaaagcggtgaggattatgtgctgacggacggattcagctggtattccagagaaggggagctgctgtgcaccgctgcccgggaggaaggagagaaggaatgaagctgatacacacaggggatctccatattggaaaaacgatgaatgatttttccctgataccggatcagcgttttattctggatcagctgctggcggcagcgagggaagaaaaagcggatgccttcgtcattgcgggcgacgtatatgaccgggcggtgcctccgggagaggcggtacagcttctggacagcttcctgacctccctgctggaggaagggattcccgtgctgttaatcagcggcaatcatgattcgccggaacggcttggcttcggggaggaaatcctgcagaagcaggggctttatattgcgggttccttccggactccgttaaaaaaagtgacgctgcaggatgccttcgggccggtaaattttttcctctttccctttgtccgccctgccgtggcaggagccaggacggcggatgaagcggtgggagcggtactggaagaggaagggaaagagggcaggatcgatcccggggaacgcaatgtcctgatcagtcacttttttgtgacctttcaggataaggaaccggagctttccgacgcggagactacgattcatgtgggcggtatcgacaacgtggacgccggacattttgccccctttgactacgtcgctttggggcatatccataagccccagaaaatagggccggataatgtctggtatgcgggagcgcctctggcttacagcttttcggaatgcgcccatgtgaaaagcataaatgtggtggagctgggggaaaaggggaaggtaaccgtgaaccagcgtcctttgcttcccctgcatgccctcaggaaggcggagggaacgctggaagagctgctgaaaaagggcggtgaggaaggcagccgggcggaggattatatccaggcgatcctgacaaacgaagaggaactggtagacccaataggcacactgcgcagcgtctatcccaacatctgtcagatcattcttgccaaaagggaaaaggaagcgcggcagacggttaaggaacggcatgccatacgccggaaaagcacggcggagctgttcgcggatttttacgggctggtgcggggaagcgaaatggatgaagccaggaaaaaggtgacggaagaaacggtgaaaaaggtggagcaggaatgaaaccaataacgttgacattatgcggctggggtcccttccgggacaagcagaccgttgactttacgaaggtgtcggaaaaagggatctttctgataacaggccagaccggtgcgggaaagaccacaatttttgacgggatcacctatgccctgtacggcagcatgagcggggagatccgggagaaaaacagcgtgcggagcgattttgcggatgcggatactcccacctatgcggagcttactatgatgcataacggcctcctttatcagatttaccggaatccggagtacatgcgtcccaagaaacggaaaaacgggggacaggccatgaccaaggaacgggaaaaggcggtgctgacgcttccggacggttccgttatggaaggcagcggagaggtgacccgtaaaatccaggaaatactgcggctggattatcgtcagtttaaacagatttccatgattgcccagggagagttcgcccgccttcttaccgcatcgccgggagaaaagacaaggattttccgggaaatctttgacaccgccctttatgaccggtttgcgtctgtgctcagggatgaggccaacaccctgtataaagaggttatggaataccgccatcgtatggatgaggatgtccgccagttccatacggaggatgaaatatggaaggaactcacttccggggaagcccatccctatgaacagcttatggacaggctggaggtgctggaaaaggactgccgcagggaagaaaaagaagcggcccgacggctggaaaagctggatcaggaaatggtggagcttgaaaaaagtatccagcaggccgaaacggatcagaaggcatttcaaaagctgagggaaacaaaagcaaggcttgaggcgcttaaaggccagtccggggatatggcacagaaggaagagcggctgaaaagaggagagcatgcggctgaaatccgcgcggaataccagcaggtaaacggagtggaaaaacagctttatgcgctggaaaggcaggaaaaggaagaagaagaggcaatcaggcgggaagtcgctcttgttcaggaatgcagcggtatctatgaaaaaagggatcttcttctggcatattatgatctcagccagtccatggaggaactggaaaaaaggaagacggcagggcttaacagacagaagcagctggagaagaagctgctttgccaccagcaggattatctggaacaggagaaacggaccgcagacaggcagcatgagctgacggaggcccagagccgttaccgccgggcggttatcggacttgcggcccggctggtggaagagggaaagccctgcccggtctgcggttcgctggagcatccgcatgtggcaggcaccggtgaggatgtgccggatgaggaacagctgaacaggcttcaggaggcgtatgatcagagtgcagccagacttaccgcccttcacggacaggcggcggcagccagggcggaggcagaaggacaggcagaacaaaaccgccagctggccgaagaggaaaatgccctgttggagaagaggggatccttttccgaagaactggtttcctttgcttctatccataacagagaggaagtccgggaacaggcggaacgctataccggtctgataaagggacttgaggtgcgcaggcagaacaaagaacgcctttccgcggataagacaaggctggaaaaggagcttgcggccgccagggaaagctgggaaaaagcccttgaaaagggcggtttcgcagggccggaggcttatcaggaggcggtcctggaggaaacggacagaaaaaaactttcggaggcaatcgcccggtaccggttggaactgggctcggcggcagagctgtgctcgcatatggaagaggaactgaagggaaaggaagaaacggataccgcccccttcctggacaaaaggaacagtcttctggaagaaaagaaaagggaagaaagcatgcgcacccgctggagtatcggcgcgtccgatgccgcccgtacctatggccttcttaaggaaaagaaaaaggacatggaaaagaaggagaaggcctacggaattatccgggatctggataatatggcatccgggaacaatgccaaaaaactggtgtttgaacagtacgtgctggccggttactttgaagatatcctggaagcggccaacttgcgcctgcgccgtatgacgggcggcagatatgagctgtccagagtggaagaggcgggtgacggccgcagcaaggacagcctggaaatacgggtgatggattactataccggaaagtaccgctcggtgaagaccctttcaggcggagagagctttaaggcatcgctggccctggcgctgggaatgagcgatgtgatccaggcggaaagcggaggcatccgggtggaagcgctgttcattgacgaaggcttcggcgcgctggatacggagtcgctggatcaggcctgcggagcgctgatgggcttagtggaaagcgaccgtatgataggaatcatttcccatgtgcccgagcttcaggaaaggattgccagccagatttatattgaaaagaaaaatacaggcagccatgtccggtaggtaaaaaagtgcttgccgcctgaggcagcggatttattcccgcgggtgtgttccccttgccgccaagcccttcccttcagccgtctccggacagtcagtgttccttgcaggggacgttctcactcggctgaaaacgcagcagtactaacgctgcagaagacgcagcgtaaggactggcgttttcagacgccccttacaggaatcactgactgtccggagacggctgaagggaagggcttggcggcaaggggaacacacccgcgggaatgaatccgctgcctcaggcggcaagcacttttttatttgtatccggatatgtccggcagaattgactttagcccgtaaaataggtataatgaacccggcaaagacagtgtgccggaacagggttttccgggacggaacagggggttttatggaacaaaaatatgatgtgattataatcggcgcagggccgggaggtattttttgtgcttatgagctgatggagaaaaataaagatttaaaggtgctgatggtggaaaagggccgtcccattgagaagaggacctgcccgaaacggaaaacaaaggtgtgtgtgggctgtaagccttgctccatcactacaggcttcgcaggtgcgggggcattttccgatggtaagctttccctgtcccctgatgtgggaggaaatctgccggaaatcctcggctatgaacagacaaaagaactgattaaggaatccgataacatctatttaaaatatggagccgacaccagggtttatggtatggataaggaaaaggaaatccgtgaaatccgcagagaggccattaatgccaacctgaagctggtggaatgtcccataaggcatctggggacggaagaaggctataagatctattcccgcctccaggacgcgcttgcggaaaaaggcgtggagatgatgtttcacacaatggtggaggaaatcctggtggaagacggccgcgcggcaggtattgtcacggataagggtgacacctatctggcggatgaaatcgtatctgcggtaggacgggagggcgccgactggtttaaggacaaatgtgcccagatcggtattgccaccacgcccggtacggtggatatcggcgtgcgtgtggaagtgcgggatgaagtgatgcagttcctgaatgaaaatctgtatgaggcgaagctgattttctacacgcctacctttgacgataaggtgcgtaccttctgtaccaatccttccggggaagtggctgcggaatactatgagggaggcctggcggtggtaaacggccatgcatacaaatcccaggattataaaacaagcaataccaatttcgcccttctggtatccaagaattttacaaagcccttcagcacgcccattgaatacggacgtaaaattgcggagctttccaatatgctctgcggaggaaaaatcctggtacagaccttcggcgatttcaggcgggggagaaggacaacggaagaacggctttgcagaaacaatctgattcccaccctgaaggatgcggtgccgggcgacctttcgctcgtattccctcacaggatcatggtggatatcgcggaaatgatagaagccctggataaggtaacaccgggcattgcgagtgatgaaactctgctttacggggtggaggtaaagttctattccaataaagtagtggtggataaggattttgagaccagtataaaggggcttcgtgctatcggcgacggcgcgggcgttacaagaggcctgcagcaggcctccgccaacggcatcagcgtggcaagaagcattttgcagagtatgggaaataaggaatgaataaaatgaaagtaaaactggctgcctgtcttctggcagtcagcctggcgctgccgctgtccggctgcagtgaacaggaaccggtgaagctggttctgactaccggtttccggcataatgaaatattccggctggaggacgcttcctgcaccctcccggagctgatggtctatctgacgacggagcagaatacctatgaaggggtatacggcccccggatctgggaagtgaaggagggagaggaagggctttcggataagctcaagaacaaggtccttgcggaaatctctcagatcaaggctatgacccttcttgcggacagaagaggaattcagctgacccctcaggaggaggagatggttgccgcagccgcagaggagtattatgcttcgctgaacgaccgtgaacgggaagccatggaagtgaaccggcagctgattgaaagcatgtaccgggattatgccctggcggataaggtgtaccggcagattatcagtgatatcaatccggagatcagtgatgacgaagccagaacgatcaccgtacagcatattctcataaagacagtgaccgaaaatgcggacgggaccatttctccttactcggataaggaaaagaccaaatgctatcaaaaggcacaggaggtcttaagtgccgctcaggagggagaggcgtttgaagcgctgattgagaaatacagcgatgattctcagggaacactgtccttcggcaaaggcgaacaggagcaggccttcgccaacgccgcctttaatctgggaaatgatgagatcagcggcgttgtggaaacctccagaggatatgaaatcatcaaatgcatcagcacctttaaccgggaagaaacggaccggaacaagctgaaaatagtggaaaagcgcaaagatgaggtattcgggcaggaatacgacagcttcgtgaattccctggctaaaaacctgaatgaacccttatgggaatccgttgtcctgatccatgatgaccaggtgacaaccagcagcttttttgatatctataaagaatatttcggacagcagtaaagccgtccacgcagggatgcatggacatattatcaatgaggaggctatagatgaaaacctttgagtatgtagtggaaagcctggatggtgattatgctaatttaaggcggacagatgaggaaagtgatgagctcaagctggtggccagggcgcttctgccgccggaaacgggagaaggaaccaggttgaaatatgagctgctccagtatagaattatggagtaaatgcgagttggaatgaggctttgtttcattttataaaaaatttataattaaggaatccagctattttaaggggtttcaagccattgttagcactcaattatattgagtgctaattttctattgacttttcagaaagttggaagtacacttattcctagagtgaaaagcggacaaaacaaaagaagaaggtccgtagaaaaaagaaaggaatgtgatgaattatggcagagaaacatggcagcttgtctattaacagcgaaaatattttccctattattaagaagtggctgtattctgaccacgatattttttacagggagctggtttccaatggctgcgacgcaattacgaagttaaagaagctggatgtgatgggagagtattcccttccggaaggctataagcctgaaatacgggttattgtgaatcccgaggaaaagaccctgaaatttattgataatggtatcggtatgactgcggatgaggtggaagaatatatcaatcagatcgccttctccggcgctacggattttattgaaaaatataaggataaatcagatgataatcagatcatcggacatttcggacttggtttttattccgcgttcatggtagccgatgaggtgcatattgatactctttcctttaaggaaggcgcggttccggtacattgggaatgtgacggcggcaccgaatttgaaatggaggacggtacctggaatcaggtaggtacccagatcaccctgttcctcaatgaggactgcctgcagttctgcaatgagtacaaggcttccgaagtcattcagaaatattgttctttcatgcctgtggaaattttcctgtccagggaaaacacaccggaaacccagactatcgacgagaacgagaagctggatacggatgaggtcctggaaaccatccagcctgagaagaaggaagatgataaggaggaggaagagaagcctgtacggctgaaaatcaaaaaacgtccttccctgatgaatgatatccatcctctctggacaaagaaccccagcgagtgcagcaaggaagattatatagagttttaccgcaaggttttccaggattacaaagagcccctgttctggatccacctgaatatggattatccctttaacctgaagggaatcctgtatttccccaagattaacatggaatatgaatcgattgagggaaccataaagctgtataacaatcaggtatttatcgccgacaatatcaaagaagtcattcccgaattccttatgctcttaaagggcgtaatcgactgcccggatctgccgctgaacgtttccagaagcgcgctgcagaatgacggatttgttaagaagatttctgattacatcaccaagaaggtggcggataagctggcaggaatgtgcaagaccgacagggaagaatatgaaaaatattgggatgatatcagtcctttcgtaaaatacggctgcctgaaggatgataaattctgtgagaagatgacagattacatcctgttcaagaatctggacggcaagtatatgaccctgcctgactgcctggaagtaaataaggtagatccggatgaagctgaaaacagcgctgttgacgaaaacggcgaaaaggtggaagcagaggtagtggaagaagaagcttcttctgaagaaggtgaaaacagcgaggaagagaagaaggaaaagaccatctattatgcaacggatttaaaggtgcagagccagtatgtaaatatgttcaaacaggctaagatggacgctgttgtgcttccggatcagattgaccagccttttatcaatcagctggaaatgaagaatgaaggcattaagttccagagaatcgatgcggatctgacagataccttcaaggcaaaaacctccaagaaagcacaggaggagctggaagcccagtcagaagagattcagaagctggttcgcaaggcgttaaagaacgagaagcttacggttaagatcgaaaagctgaaaaataaaaaggtttcttctgtactcacaatttctgaagagagcagaagaatgcaggatatgatgaagatgtatgccatgaacggcatggatatgggcatgttcggcggtgaaggggaaaccctggtgctgaatgccggccatcctcttgttcagtatgttctggatcataaggatgataaggataataagaatgaaacccttatctgtgaacagctgtatgatcttgccaagctgcagcagggaccgctggacggagaagcgatgactaaattcgtgaaccgttccaatgacattatggttgctctgacacagtaaaaacggcagaagaagattattctcctgtaaagatataaatcccggcggtatgagcctgtttaaggcagataccgccgggatttttatgcctgaaatatttttaacgaaaaaatacgttaattaacggctacagtaagaaaccggcaagaaacatcagcagggacagcagggtaaagaggacgagctttacataggaagggggatcgatcagggtatccggaaaaagaacggcataccatacggtgacctggctgccgatatccttatcggcagagaccgggatttccctttgggaaaaataactgcggccatccacactataggtaacataggccatattcttttttcttttctgtttcccggaaaaaggtccggcatggcggctgtcttcggcggaccggagacggattttggtgacggtagccaccgttttacgggagcggggctgtatggcaataagattgatagcttccataagtatcaggaataaaaacaggactccgagcacataaaagagctggttgactgggtgactcatatagtgctcctttcacatcagttcttttcgttggaatatttttacggtaatgcctgccgaaaggatcaacaggattacactcaaaagcagcaggaacagaaaagcaggaagcacaggcagcccgttcagccagtttgcttccagcagatcggttttgagcagaaggggcagcagaaaacaggaggccatgataatgattacgagtacgaatttggaattttcaaatccgaacagatgctgaagcggtgtcagaatactgaaaagaagggcattcaggaagaatgcgacagcatattccggtggggaaaggcggaaagaggccgccagcaccagcgagagccctgtataaatgatcgaggttgcaacaaacaccagacagaaaagaatgtatctgctgatgataatatcacttctccgatagggggaggagcagagcagggagagagccctcgggcattccgcatccttcaggaaaatctgctcataggcaaggaattcactgtatatggaggctatgataagaatcagcaggcccgtgcccttctgttcggcgtattgcgggagacgccaataataaaagaagggaagtacgaaggtaatggcggggatgaaaaaaaggtaattccccataaggaacaggtctttttttaacagagaggtatattgtttcatgaggaagtcatcctcctttcggcgttgtttccggcagttgacaggggtgttgtgcgcccttcgcacagggcgatcatgatatcttcaatggaggcgtgttccagcagggcatcggggaaaagctgtttcgctttttccggatcatcaataagggccgtgaagccgtaatccgtggttctcagacagttcaggaattcttttttgccttccgtaagggaaggcaagccgcccttcaccagccgccatttatccagcagaatgtccttatcctcttccagaaggattttcccctgatggagaaaaacaatgttatccgcacacttatccagatccgaagtgatatgggtggaaaagaggacacccttgcctcccttgtccatgaattcacggatgagagaaagaaatttatctcttatcagaggatccagcccgctggtaggttcatccatgatcagcagttcagctctgtgggacagggcaaaagccagtgcaagcttcattttggtaccggaggaaagggtttttattttctgggaaggattcagcttgaagcgggaggccagctcctggtattccttttcctgccattgggaatatgcgccggcaacgatctgtttcatctgggaaacggtgaggccttcgtaaaaggcgcctgctcccagaaccacgccgatacgatcggccagggcccttctgtcggaactcctgcgcccctcggaagaagcctgttttttggaagaagggaccggttcgccgaacagacggatttccccgctgtctggttccagcagtccgagaatggcacggagcgtggtggttttgccggcgccgttggcacctacaaaaccggttatgcagccttccggaacggtgaagctggcctcggaaagagaaaagtccgggtaatgtttgcttaagccgtttacttctataatattattcatttgcttcgtctcctttgcagatatcgtcgtacagaatatccagcatatcatgcagttcattgagcggaatgccaagtccggaagctgtctgaagggtttcctgcatcttcagttccaccagatgacgtttggcatccctgagcagttccatatttgccgcagaaataaatgtgccgatgcctacctgctgcttcagatacccttcggcctccagttcatcataaacccgccgtacagtcaggacactgacccccaggtcattggcaaaacgccgtatggagggcatgctgtccccgtctttcagttcttcccgcagaatggcatccttcagctgttccttaatctgcatatacagaggctgatcggaactgttagaaatcagtattttcatgaaatttacacctttccggcaaccggtttgccaagtgtgtatgtgtataatacacactatacacttaaatctcttttttgtcaattcatataataacacttcatggttcctgagccgtcagccctatgggtttctctgtccggccattcctctcctgccattctttgcgggtcgcgggtctgcaaggttcctgtacgggcacgctctcgctcggataactgcgcagcggtactaaggctgcaaaatacgcagcctaaggaccggcgcatttatacggcccttactggaatccttgcagacctgcgacccgcaaagaatggcaggagaggaattgccggacagagaaacccatagggctgacggctcaggaaccatgaagcgcagcatgcagaaatttccaaaaaagtatttgacaaataaaggcctctttattataatcaattaaaatatactaatccaataggaattgtaaacaatgagattggatactgcgaaggcaggaaggagagacattatgggcacaaagacggaaagaaaattcaggtttgaaacattacagcttcatgtggggcaggaacaggcggatccggctacggatgccagggctgttcccatatatcagacatcttcctatgtatttcatgactgccaggatgctgccgacagatttgccctttccgcaggcggtaatatatacggtagactgaccaatcctacggaagatatatttgaacggaggatggcggctttggagggcggaagcgctgccctggcggtggcatcgggagcggcggcgattgcctatacctttcagaatcttgcccatcagggcgatcatattgtggcggccaggaacatatatggcggcacatataattttctggcacatacctttcctgatttcggggtgacaactacctttgttgatccctttgacgaaaaagagctggaaggagcaatccgtgaaaatacgaaggctgtattcctggagacactggggaatccgaattccgatgtggtggatatcgaagggattgcccgcatagcccatgcccataagatccccctggtggtggataataccttcgcgactccttatcttgtgcagcctatagcgtacggcgcggatattgtagtccattcagctactaaatttatcggcgggcacggaacggcggtaggaggagttatcgtggaaggaggctcctttgactgggaggcttccggcaggttcccttctcttacggagccaaatgaaagctatcacggcgtttcctttacggaggcggcaggccctgcggcctttgtgacgaagatacgggccatcctcctgcgcgataccggagccaccctttccccttttcatgcatttctctttctgcagggacttgaaacgctttccctgagagtggaacggcatgtatccaacgctttgaaggtggcttcctatctggcttcccatccccaggtggaaaaggtccatcatccgtctgtaacggagaatgcttcccagaaagccctgtattccaggtattttcctaatggaggaggttccatttttacctttgaaatcaagggagacgataggacggctaaaaagtttattgaccatcttcagctgttctctcttctggctaatgtggctgacgttaaatctctggtgatccatccggcatccactactcatgggcagttgaacgaagaggagctaagacagcagggaatccgtcccaacacgatccggctttccgtgggaacggagcatattgatgatatccttcaggatttggaagaagctttccgggcagtggcagaagaaaaataagaatgagaaaataagaataaaagaaaagaataagaaagcggcggcacgcatcgattggaatcgttgcgtgccgcctttatccccacaggcagctgcggaagtaccccggcggctgctgagagggtccaatcccctgcagtcagcaaaagattggacggataaggaggaggcttgaagaaggctgtttaaaaagtggggtaagggctcagtccggctcggcaatccgggaaacgcccacaaatatcctggaaatttcataccaggtgggataatccacagcccctgtttggggaaggccgaaaacccgctggaaaaccttcaccgcatccgctgtctgctgtccgtaaaccccgtctgcggctacataagggatagcgggataattctggctgatccggttaagctgttcctgcatctgcagtaccttagcgccagaggagcctatagtcagggtatagccgggccaggaggaaggaatgccgctgatggcatcggcagtgttgatatacatatcgctgccataataataatgtatgatctccatagcgctgtagccttcgtctcccagatatttggaaccccattggcttaagccggagcagttaaccctgcggccgtcacaatagctggtcaggatgggctggcgcacgccgggccgggagaggtaattggcgaaaatggtatccacaaggtagctgatgttttcataaatattcctgccataaatccatttctgatcaaaggcagtagaggaggtaatggtaaaattatatccctggttccggtaccattccgtataaacacggttcagggtaaaggacataatagccagtatgttcgcataaatggtggattccggccaggtggcataaatttctgaggaagccacatttttaatgtaatccgtatagcgtacataataattgggcgcagaggagtcggtgggaactccgtcgtgtaccactacatattccgggataaccacacggcttaaaacgatttcgccggtttcatccacgggttttatctcggcctcggggattttagggggatagtctccgtataaggtatgatcggggatgacgatgtcttcctcctgccccggtactgcctcggggatcagggcgacgggctgcagggaaagaacatcgggaaggatttccgagccttctaccaccacaggttcatagccgggtgcttcaactgtaatattatattcggaatagggtcgttgttcggaaggtgacagactgtagtccaggggaggcgcgggcagttcgaccacatcggtctgaccggaagcatctgtggtcagtgtatctaagatcacatcaggtgattcagtcagagcgatggatacggttgcgccttctatgggaatctgccccagggtggatgtaatgctgattttcagcccgccggcgtagggactgtcagtggtctgcgcggcatgtagtttttttgccatatgtgcggtagcctcacgattgttacttacgtttagtatatgcaggaatttccggcaggttccaaaggacaggacagaaaatgggaggtatttgcaatatctgcagtcaagatcggaatagaaactcatgctacaatgatactgtgaggtgaaggattatggacagaggaatgtgggtaagagtattgaattatgtggacagtcatatccatgagaaaatcagtttatgtgatttggctgaaattgcaggttacagtcctttttatttcagcaggctgtttgcagaagcgatggggatgcctgtaacaggctatatacggatccgaaagcttcagcatgccatagtatctcttctggaaggaaagaaggtgctggaggttgcgctgctgtatgcgttcgattcgcatgaagggtttacacggtcttttacacagcttttcggttccactccaagtatgatcaggaaaactttgaatacttatacggtgccggattatagtgtgccggaagaaaagggaaggagaagtcagatgacggaaaagcaggaagaaatggaggacagcagacagcagcttgtttatgaggtgctgagagagtccctggaagaagcgggagaaggctactgtactgaagtggaaattgtacttttgccggaagggggaattaaaattcgggataatggaagaggaatacccttatcagaagatttacaggcaagtaaggaggtactggaaaaaattctttccggaaggccggttacgaatgtggagttcagtcagatgggagacctggttcaggcgggactgcagacagtgaattccttgtgtgaaagtctgaagattacggtttatagagacggaagaaaatatcagcaggattatatccgtggtattccgcagcatgagctttttattgacagagaaaaacatgcttcgggaacagagattattatgaaaccggacacagccatattcggatatggtgaattttcggaagataagcttcggaaatggatggaaaaacagatatcagacaggaaggaactttctgttacgataaaaagacaagagaaccctgaaggatgaaggttaggcatcaggagaacctgctagcggcagaaaaatttaatatgaaaaaagcaggcggaatttggaatgttttcccgcctgttttttcattatactgtttatcaatccagattcaattgctttttcatcaggtactcggaaaggatgtagcagccgatgccggtaagaacacatgccacgagactgaaaataaaggtatttcgcatgaaagctcccataaattccggtatttcaagactggttgagttgccgacgtgggttacgaccattttcgtaaggtaaggggtcatagccagggaggtcaaggtctggattataatagtaacaccgatatagcacaggatagaagccattaccttatgcttggagaacatctgtcccagagaaaccgcgccatatacaatcagtacattgcttactgctgatatgaggaaataaaagaacataaatactgtaaaaacgggcagggacattccgaagagtgcatgggaatattctttcgcataattcaccagcagggtaaatgacaaatttaaatcatctttaaccatgacaggtaaaccaaaaatcataattaagaacacagcccacagagtcaggatggtaacaagaaaactccataaggatccaaccgtgagcttggaaacgagcagctgtctgggcgttaccggaagggtatgcataagataaccttcgtcggtatacaggttcttataaaaacgtaccgcaatataaatgctgacaaccacactgacacagcttatggtgagaacataaaacatcatcagtacaaatgcgcctgcattcagttcgtcggcatttgcgggaggcgacatccgggtaaagcatatgacagataccagggtgagtatgatcatgagtgcacaggccagcgcaggtatgcgccaggtttctttccattcatgtttcagtaattttttcagcatgcgaacacctccctgaaatagctgtctacggatttcccgtaggtttcgcggatttcttccacagaggagcaaagcataacctgaccgtccctgataaagatgcagtcatcaagaaccgcttcaatatcggatattaaatgcgtggaaagaagtatagttgcattttcattataattgccgatgatagtcttcaggataaaatccctcgcagccggatccacgccggcaatgggctcatccagaatatacaggtcggcatccctgctcataaccagtacaagctgtactttttccttggtgcccttggaaagggttttcagccgggcatgaagatcgatatgaaggctttccagcatacccaatgctttttccttattaaagttatcataaaaatctacaaaatattccactaaatcctctaccctgcggttgcttgtcaggtaactgcgctccggcagataggaaatcatggccttagtctcaactccgggcgtatggccgtttatcaagatctgtcccgaagcgggggtcagaaggccgttcagcagtttgattaaggtggttttgccactgccgttggggcccagcagaccaataatacgtccccttggaataaccaggttcatattattcagcgctgtgaaatgaccataggtcttggacaggccggtaatagttaccagttcattcatgcgagctccctccttgtattttcgggttcctctgcagcagctgagagtaatgtgataatatcctttttctcaaagcccagctctttcatcttagcgataaatgcattgatttcttcttttgccagctgagtccgaatttgtgtaatcatatttttgtcctccgttacgaatctgccgctggttcgtttggtttcaatcaggccgctgcgttccagctcggcaaaggccttctgcatcgtgttcgggttaacactggcctcggcagccaaatcccttacacttggtagcttatcgccgggagcatatatgccggacacgatctgaagctggatacgctccagaagctgtgcatagatggggcgatctgaatccaggttccatgccatatcatcattcctttctgtgtttccttattcttaatctgtattactataataatacaataatgcagaataaataaaatgtcaatagtaaattgttatttttcggagtcgtcagtacggtacggctgtactgcgggctttccgcagtagccaggagccgctgcggatataattgctataccgcctgattcctgctatacttaatctcagaaaaattcggggaaaaacaacaaaaaaagtacggaagccggccggtacagacgaaatccccgctatacttcgtcggtctataatgacaggggagaagccggccaatataatgtatagcatgatttgatgaataaattacaccatatagcagaaggacagaaagaggagaatgttaccggatatgaagacttggatagaaaaagcggcagcagcggatattgatgaaatggggagactttatgacagcctgaatgactatctggaacagcatgtcaattatcccggatggagaaaaggcatttatcctgcgcgggaggatgcggaaaaggggattaaggaaaaaaacttatatgtgcttagaaatgagcggcagattatgggcagcattatattaagtcatgagccggaagccgcttatgaaaaagcggactggcatgtggatttagaatataaggatatttttgtaatacatacctttgcagttcatcccctttatctcggaaacggcacaggaaaaaggctgatggaattcgcactggagcaaagccgggaggagaagataaaggccatccgtctggatgtatatgaaaagaatacaccagccatctccctttacagaaaatatggcttccactatatagatactgttgatttgggatatggagagttcggcctggataattttgagctttatcaaaaattaatataaaggcaaaggagaaaaagcttatgcaggacaaaccgttttgggaacagagctattcggattatgaggtttccactttttccaaggggcctacggcggatgtggaagaattttatgaaatgtttccccgtaatgcagatgtattggatgtgggctgcggggaggggaggaattccatttttctggcaaagctgggaaacagagtggaagcctttgacatttcagaaaatggaataaaaaaggctgtaaaaatagcagaacatgaaaagatccctgtcaccttttttacctgtgatctgggaaaattcgtatttaaaaaagagtatgatatgattctttcccacggggtactgcatcttcctgtcaaagaggtacgcgataaatttatacgggacatgcaggcgcataccaaagaaggaggcttccatgtgattggagttttcacaaaccggcttcctgccacacctgacaatgcgccctttacccacagtctttttgatgtgggggaactgcccgctaaatatgccggatgggaaatcgtacatcacgaggaaggtacgtttacggacagccatccgggagatatccatcatgagcatgcttatgagcggattattgcgaaaaaggtgcagaaataaaactgccgtcaatcacatccttgatacattccataagccttacattatcctcatgtctcataaaacagaagcggaaaaagctttcatcaaggctgtgaaagctggagcagtccctgatcatcattttattccggatcgcggcttcaaagatatcaccggcagtgattccctgtttcagtatccgtacgaggacgaaattggcatatgcggggaataccttcaggccagggagctctgaaaggaaggagacgcagtattcccgctcctcccggatcaggctgcgtgtccggtttatatattcggtatccgtgaacataacctggcctgcagcatctgcaagggaactgacggtccagggatttttggcggcgtttatctgttcctgaagcttccggttcccggtgacggcatatcccaggcgaaggccgggagcggcccagaacttggatacgccccgaaggacaatcagattatcatagatctcagtgagcggaatggcggtgatatcggaaaggcagggggcgaattccgcataggtttcatcggccatgaccagaatgccattacgtttgcacagcgacagcaggcgtttcatctgctctgttgttatggcgctggaggttggattattgggattgcacagaaccagaagctgcggcaggcagggtatgcttttgccgggaatcgtgtccgtatcatgagaaaaaatatcttcggtaataaatttttccaaatcctccacatccagatggaaatcctccgataccttcagatcataataatgcatccgactccccacaagggaaagctcccgctcatattccgaataggcggggccaaggacaacggcgtcctttggatggacagcctggattccggcagaaatcagctccgtggagccattccccacgaggatatgttcagccggagctcctgtgtaggcggatatggcacggcggagagcggtgtaattccggtcaggataagcgcataatacatccagatgcccggccagataatccttcaggaaaggggagagccccaggggatttacattggccccgaagccagtgatttcttcctttctgatgccataaacctgttctattttttccagatcacttccatgaaatgtgttcatataggctcctttttctactttgaaatgttgcaggaatccttccggtaatgttatactgtatactgatattaattctttttcaatagaaatacaaggcaggatatagattttacaggaggtgagagctttgaaggagctttatgcgaaggtttctatggaagattggcaggaaagtggcgggcctttggagctttcatgccaggaagtgggactggctctgaaaagagatgaagtgaaggaaggtttctttacggtgaccggggaacctgggcaggtgacggaaggatatgtctcctgtgatgaagagcgtatggaatgcctgacttcttttttttcaggtaccagggagaatatagagtaccgttttgattccaggggaatgcgggaaggggaggagcggaagggaaggttcctcatcgtttccaatcatggggaatatgagatcccttttcatgcggtggtactgcacaaggtgctggagagttcggaaggggaactgatgaatctgtttcagttcacgaatctggcgagaaacaactgggaggaagcggtgaagctgttttattcccccgattttatccgtgttttcaacggtcaggataaaaagtaccggaacctgtacaagggattttcccagataccggggaatatgcagaacgtggaggaatttctggtttccatacataaaaagcagtcggtggaatatatgctgccccgaacggaaatcgtgataacaagccttcatggacagttgtgcgaaaccctgcaggtggtaaaaaacgggtggggttacagccgtcttcaggtggaggtggaaggagatttcatttccacggagaaaaaaatcctgcgggatgaagattttttgggaaaccagtgcgggctgcctgtctttgtgaagcaggaggccctgcatgaagggaaaaacttcggcagaattattttaagccatgcctacggacaaatgcaggcgtcggttactgtcataaaaagaggcgagcatcgtgtggtgaggacaggccggcggctggaaatgaagcggctgacggtggagctggtgcggctataccagacctataaaatgaaaaaaataaatatgaagctgtggaaagcgcagacaggtgaagtggtggagcgtatgaagcggctggatgacaaaaatccggcgatactgcttttccaggcgcatctgcgtattacggaggaaagcttcgacgaggcgggccggattttggagcatctggatatcatgccggatgaaaatatgccggagctttattgctattatctgtatttaagcagcctttatcagaggagtgaatcctatacggcagaggttaccatccaggtggaggactatcaccggacattccgggataactggcggattgcctggcttttgctgtatctgtccccaaccctgggcaggagtgtttcccagaaatggcttttcctggaggatcagttccgtcacagcggcaccagtccagtcctgtatctggaagcgcttcatctggctaatttcagtcccacgctgttgatgaagctggatacctatgagcttcagctgctgcatttcggggccagaaacgggattctttcggaggatctcatcggacatatggtgtatctggcaggaaaagaaaagtattacagggagagcctgtttggtatcctgaaggactgctaccagcagaaaagcgatccccagctgctcacggcaatctgttctcttttgatcaagggaaataaaagcgggccggaatattatcagtggtaccgcaggggcgtggagcaggagcttcgggtgacaaggctgtatgagtattatatgatgtcggtggacacggaaaaggaagtggagatcccccgtatcgtgctcatgtattttgcgtaccagagtaacctggaatatgataaatgtgcctatttatatgcttacatacagaagcaccgggaggaatttcccgagctgtatctggcttataaaagccagatggatcggtttgtgcttcagcagctttacaaggggcggatcaacagacagctggccttcctttatcagaccgtgctggatgaaaaaatgctgaccagggataactgccaggcgctggctcctctgctttttattcagcagctggattgtgagggaaaggatatcaggaaggcggttgtcatccatacgaggctgcgtggagagcaggtctatccagtggagaacggcagggcctatgtggcggttttcgacagggattatgagatccttctcgaggatgaggagaagaaccgttatgcggcggggcgtcccttcgtgctggaccggctgatgtatccggccagatgtgtgaatgcgctggagcctcttgtggagaaatctcttggtttcaatcttttcttctgcgagagcagcaaggggaagatacgtgttacggagaaaaatgcatcccggtttcgggagttggcggaggattcccgtattattccggcttttgcaagggcgatacggatagagcttctgagatattattatggacatgaagagctggaggaactggatttactgctggaagccttgaagagagaggatttggacggttccgatgtttatgaggccattggttttctggtgcttcgttccttttatgaaaaagcatttgcctggctgaccggactggctccggaacgggcggatgccaaaatccttctccggttatgtagcaggatgctggagacggggcttggtatgcaggaagaggaaatgacgaggctggcctacagcgctttttgccgggaaaaatatgacagccgtgtcctgcagcatctggtggagtattatgaaggaagtaccagggagctgacggatatccggcttgcggcagagaatttcgcagtggatacctatgtgctgacggaaaggcttctggtgcagcttctctatatcggggacaacgtgatggggcggatcgggctgctcaggaaatatattatcggcggaggaaagagcgaactggagtcggcattccttcacaggtgcagcggcctgtatctgatgaatgcggagccaatggatcgttatgtcattaccgatatcggaagagtggccggcaggggggaaatgctcagtgatatgtgcaggctggcttatctggaatattttgcccgccacagggatgaacgcagccccaggacggatgcccttatcaagtgtttcggggatcagctcatccggaataacatgaagctgccgctttttcaggaatatgtggatattcttgagggggcggaaaccatgatggataagacaatggtggtcttcaggggaaacagggaacgtccggtaaccataaactacaggatcgttccgtcccctgccgacggaggggagctgacggcggcacagggaacataccgttcctttgatttgcagcatatgtatgcagggatttatacggccagttttgtgctgtttgcaggggaaagcctacagtatttcataactgacaattccggcggcggtgaaatccttgacagcggtgaactgaaaatgggggaatgcagcgtctttgtgaaggaaagcagatatggaatgataaatgacatcgcttccgcccggctcatgatggaagaaggggaagcgcaggagctgttggagcagtatctgcttacggagtggatgacggaggggctttttaaagcaatggagtagcagcgtcccgacagaactgagtagttataccgaacagaaaggcaggtgaggaagatgtttctgggaaatccggacagaaaaggcggcgcaggcgctttcataggatatgatatcagtgacaggtatgcccagatcagcttctggctgccgggagctgataagccggaaacactctcccaggttatgggagaggaagaatatatgataccggcagtgttatgccgccgcagggacagggatgtgtggacctatggaagggaagcattgaagaatgcggaggccggagagggcgttcttgtgaaaaacatgctgtcccgggcgcttgccggggagagtgtggaagtggagggagagtgctttgatgcggcggttctgctttccctgtttgtgaagagaagcctttctcttctttccggggcgctggttccggaaaaagcggccatgtttttatttacggtagatgaggtgaataagcagacaatagaggtgctttccagagtggcggccctcatttccctgcctccggatcatgtatcctgccagagcaggggagagagtttcttctattataatatcaaccagccggaggagctttggcgtcaccaggtaatgatttgtgatttttccgggacggccatgaagcttcttatgtttgagatgaaccaccatacaaggccggtgacggtaatcgtacgggaagatacctacccggaaattgcaagaaggctgcagcctgaggaagagccgggggaatcggaaaagcagaggatggatgagcggtttgccgccgtcctggaacgggtatgttccggaaaaatcatcgatacgatatacctgattggcgacggttttgaaggggactggtatacccgttccctgcccgtgctctgccggggaagaagggttttccagggaaataacctgtacagcaagggcgcctgttatggggccagggcgaaacagcagccgggagaaaacggacagaattacgtatatctgggaaaggatatgctgaaggcaaatatcggcctggaagcttccttcagagggcaggattcctattttgccctgctggatgccggtgtcaactggtatgatgcgagaagggaatgcgattttcttctgaatgaggatcattcgttttccctgagaattacgcctcttaccggccgtgaggtaaaggaagtggcggtgacgctggacggagtcccggagaggccggcaaggactacaaggatacatctgacagtttttctcagtgatgcggatacggtacagctgaagatggaggatatgggtttcggtgaaatgtttcctgcatcccataaaatctgggaggaagccttcagcctgaaggaggaaaacgatcagaaaaaggaaggggatcgggtatgagcagagtccatttatgccttggaaggacagcgtcagctccatacagcttcgacaaggcccgggtccgcgtttattccgtagaggaattatgctatttcctgaaggaaaatgcatatcttctggatgaaaccatttttaccagaggcctgtcggactggctttataaggaatgcggcctgccggatttgggtcagaagctgaatatgcttcagaaaaataaggaaaagccggaggcctttgtaacggcgatttttgaatacacgggttacttcaggcaggaagaaatacaggaaacggagcgtcttgtaagggtcagcgccgacgtttctctggtagaaaagcagaaagcgagagcggattatttcctggagagccgtcgttatgtgctggctatgcaggaataccggaatctgcttcaggatggagatgccctggcaccggatttttcgggtaagatatatcataacctggggaccgcccaggcgaagctgttcctgtttgaaaaagcggcggcttcttttgagcaggcttaccggcttaccggggatccggagagtctttttcagtatctggcggccatgcgcctgcatttgaaggagccggaatatctgaatttccttacggagcatgcggagtattatgaggcttccctggaactggaaaaaagggtggttgcccggaaggaagcctgggtggattcccgtaaccagtctatggtggcggagatcaagggggcttttttctcgggagaggaggaggcctgccgggaattgatgcggcaggaaataggaaagctggaggaggagtaccgcgattatgtggtgcagtgagtcgattccacgttcctctcctttcctcgttgctgtgcctgtctcccgccgctgtccgggtgtgagtggtctgggggttcggacataaaaaggatggcatttctaagcgttcccatgttctgtactgctgtcaaatggcttaaactcctcgcataagcggcctttggccgtttatgttcgtcagacagcgccatttgggcggacagcagtacagaacatgggaacgctaagaaatgtcatcctttttatgtgactcaccctcagaccactcacacccggacagcggcgggagacgggcacaggacgaggaaaggagaggaacgtggaatctgtacgatatcggaggggagaagggcaagagcaagagaaaagggcaagagcaagagagaggaaaaggtaagagatagagaacgggaaggagtttggtgttgggtgggtaatatttatagttggtgaatgggaaaggattggtgtcgatatggcttttatgggtgttttgattgcggcggggcttttttatgtggtgtttttgatttggctgggggttttggttcttggggttgttttgttggttttggggattttgtttgaggtgttttatgggaggaataagaggaggctgggggttgatggagttgggaagaagaagtggcagaaggtggcggggattgtttgtctggtgatttctgtgattaatttggggctggcggggggaagcttttattttattacgcatatggggccggaaacgaagacagttagtactgaaaatggggttgtgagtgttttgcaggaggagagatttgcttttgagggtgctgtggaacgggatgatttggatgaggtgaagagggtgctgggggaaaatccggcgtattgggattataaggcggttgatggttctacggttatcgggattgcaattgcgaatggttctgtggaggttaccaggttcttgctggaaaacggagtggatgcggatgttgtggggagcagtacggatacggctttctggaggtgtgtgaggaagattaaagagggtatttataatccggaaatgctggagctgttgttggattatggagcgtctgcttatcgggaggaagtgtcttatctgaatccgattatcgcggcaatgtgtgaggatggtgatttgacggatgaggagctggatcttcttgaacggctggtggatgccgggatgagccttacgaatacgaatggaatcggggagaatgcggaggcgtatttggagagaataggaaaagaaaaaggaatcgcggatgaccagccggatcagtatgagcggggattggagctgcttagaggctgacatacagtgctgtttctaaattcacaatgggttttgctcactgtgagtagtgaagagtgtataaaatatttaataggaggatataaaaaattggctttgctgaatgaattgtcatgctgattttattcatgggggcattttcggcaatggaggtgttttttgtcatgaaatgatacatgaggtgtgggaacggaggggccgcggtcgggactgatgtttctatactggaacggagtgctggtttgtggttgcctttcctctatattcggcgtaattagtgttggacacatactgaatatcattgtaataagtgtcaacgcttgatataatataaatatcttatgttgcagaatatccgaaagatagcgaggagtggtaccttatgtatcgtagtgcaatggaacagctaaataaatggaagcaaaaaaccaataaaaaacctcttattatccgtggggcgcgtcaggtaggcaaaacgtggctcatgaaagagtttggcaagactgcttacgaaaaaacggtctatattaactttgataataacccgcagatgaaagaacttttttctttggatatgcgtattgaccgcattatcatgggacttgaactttatgtggggcataaaatcagtcctcataataccctgcttatctttgacgaggttcaggaagtgccaaaggcgctgtcctcactgaaatatttcaatgaaaccgcaccggagtatcaaatcgtttgtgctggttcgcttttaggcatagcactccatcagggcacatcgtttcccgtgggcaaggtggagttcatggacttgtatccgctgtctttcactgagtttatgcgggcaatggggaaggagcagtttgtggatttgcttgacaagggtgattttgagatggcaaccatgttcaggcaggattatgtcgacttgcttaagtattattattatgttggcggtatgccggaagttgtccagagctttgtcgataatcgggatttcaatgaagcgcgggagatacaagagcgtatcttagctgcatatgagcaggatttttccaagcatgccccgaatgaggcggtgccacgtatccgtatgctctggaacagtattcccgcacagcttactaaagagaacaagaagtttatttacggtatcatcaaagagggtgcccgggcaaaggattacgaaacggcgcttatgtggctgaccgattgcggacttgtccataaggtttatcgggtgactgcgccgagtatccccctgaaagcctatgaggacttaaaagcctttaagctctttctggcagatgttggtttgcttggctgtatggtgcgcttgaaccagtctgtccttttggacgggaatgagcttttcaaggagttcaaaggagcgttgacagagcaatatgtattgcagcagcttaagacagttaaaggtgtggacacctactactggacaaatgacagagggaatgctgagatagattttctcatcgacacaggcaatgaggttgtccccattgaggtcaaggcagaaactaatttaaaggcgaagagcctcaagaccttctgcgagaaatacaatcccaaaatggcgatacgcacgtctatgacagattataagcaggaggattggctgttgaatctgccgctttgggcggtggagaaaaagttgagtttattttgaccataatgagaagaaaaggtcagaatgaatcgaacggaaagcaatcgtggttgaggacataaaaaagtcataaaaaagagattattgcttttgtattgacatatgaaatctcttcgtgataggataattccagcggcagtttagtctgataaactgctaaattactaaagaagcagtgcgatgcattgtttccggcatgaggaggagaaaattatgaaaaaggcagttgcaattttgctggcaggcatgatggtattcgggcttgcgggctgtggttcaaagacttccgaaggagcgggcagtgaggcagtttcggctccggagagcagcgcggcggcagagagtacggtgacggaaagcacggcggatacgcaggaagcggagagcacggcggcagcggatacgggagaagggcgtcagtttgtagttggtttcgatgcggaattcccgccctatggttataaggatggaagcggagaatatgtgggctttgatctggatctggcggctgaggtgtgtaagcgtcagggctgggagctggttaagcagcctattgactgggattccaaggatatggagctggattccggcgcgattgattgtatatggaacggctttacaatgaacggaagggaagatcagtatacttggagcgttccttatgtggataacagccaggtatttgttgtggctgatgattccggtatttccgtgaaggcggatcttgcaggcaaggctgtaggggtacagaaggattcttccgcactcgccgctttggaaggtgatgagaaagagctggcagataccttcggagcattgaatcagtatgcggattataatacggcatttatggatctggaagcaggggccatcgatgcgctggcgatagatatcggtgttgccaattatcagatttcctccagagagggcggttacgtgattttggaaggggcggatcatgcggagtatttatccacggagcagtacgggatcggatttaaaaaagggaatgaagagcttaaggatattgtggaagccactctgctggaaatggtggatgacggaagctttatgacgattgctgagaagtatgcggattacggtctgctggacagtatctgtcttggcaaataagccaggtattctaatgcttacgggaagaatatatacagggggaaagccgcagcagcggcttttttccggttgaagcagtagaaaaaatgcaacagcgcagacttctgggctgttacgggaaaaggaagttggaggaaaccatggaattgggtaaaatgctgcagcagctcacagggggcatgctgattacaacggagatttttattttaaccctgttgttctctctgcctttggggctggtattatcttttgggaggatgtccaaagtcggggtgattcgtttcctgacgaaggtatacatatcgatcatgaggggaacgccgttgatgctgcagctgattgtggtttactttgcgccctattatgtatttggtctgaaaatttcccagggttaccggatggtggcggtaattctggcttttgtcctgaattatgcggcttattttgcggaaatatatcgttcaggcatagagtctatgcccgtaggacagtatgaggcggcgaagatgctggggtacagcaaggctcaaacatttctgaagataatcctgcctcaggtgattaagagagtgcttccggcggtgacgaatgaaatgatcactctggtcaaagatacttccctggcttttgtgttaacggttaccgaaatgtttaccatcgccaagcaaatcgcggcggcgcaggcttccgttatgcccttgatggcggccggtgtcttttactatattttcaatctgatagtggcgatggttatggagcatgtggaaaaacgcctgaactattacagaggataaggcggaaagaatgaatttgccattcttccggcagataaaaaagagcaagggataggagcaaaatgagcggaaattttcttgagattaaaaatatgaaaaaaacctttggggagctggaggtcataaaggacatctctctttctgtaaaagagggggaagtggtttctgtgatcggtccctcaggttccggtaaatccacattgctgcgctgtgcgaccatgctggaaaaaatggacggcggcgagctttcctatctgggggagcgggcggcatatgaggaaaacggaaaatgtgtgtatgtctccaaagccgatcggaaaaggattcataaatatttcgggctcgtatttcagaatttcaatctgttccctcattattcggtactgaagaatatcattgacgcacccatgacggtagacggaatctccaggaaggaagcggaggagcgggcggagaagcttctcgcgcagctggggctttccgacaaaagagatgcttatccctatcagctgtccggcgggcagcagcagagggtttcgatagccagggcgctggcccttcagcctaaaatcctgttttttgacgagcctacctcggctctggatccggagcttacgggggaagtgctgaaggttatcaggcagctggctcaggagcatatgacgatgatcatagtaacccatgaaatgcagttcgcaagagagctgtcggatcggatcattttcatggagcagggtgtgatttgtcaggaaggcacaccggaggagctttttaattctccgaatgcacgggttcgtgagtttattgggcgtgttatgaacgtatgatttgtagggttatgctttttcagaaggctgacggccgtattttttggcattatgtagaaaataggggagtacggtctatgagttcttgatttctgaaaattggtgcgctatacttgtaacagtaatgccgctttttttacagggtaatttctatggaattgccggcagatactctttttcagaggaaaagtggtatggaaaattacgcaggatggctttcagaaagccatctttcaaatttacggcgctttcatgagcgcagatggaggataagatgcagaaactggaacagctttatgaaggaaaggcaaagaaagtttttaaaacagatgatcccgatgtgttaatcgtggattacaaggatgatgctacagctttcaacggagagaagaagggtactattgtaggaaaaggtgtcatcaataacaagatgagcaaccgtgtgcaccagcttctggaagaaaaaggtgttccgactcattatatccaggaattaagcgacagagaaaccgccgtaaagaaagtggagatcgtaccggttgaagttattatcagaaacgtggcagccggaagcttttccaagagactcggtgtgccggagggaactccctttgaacagcccaccgtggagttcagttataagaatgacgaactgggcgatcctctgatcaacgattattttgcagtagcgctgaagctggcgacctgggatgaaatcaagaccatccaggattatgcatttaaggtaaatgatgtgctgaaggagtatttcctccaggcaggcatcaaactgattgactttaagattgagtttggccgttaccacggacagatcatcctggcagacgaaatcagcccggatacctgccgtctgtgggatgtcaacacgaatgaaaaactggataaggatcgtttccgccgtgatcttggaaatgtggaagaagcctacaacgaagttttcaaacgtctgggactataagaaacataccgacggaggcctgaaggaaaaaggattgggtaagccgcggtaaaaccgcggctttctgcgtgatacgggacaacaaaacacaacacagaaacgaggaggcatatgacggaaaagagcatctatgagcaggcaaaagtaacggacaagcccggagaagaatgtggtgttttcgggatgtatgattttgacggcagtgatgtatcaggcagcatctattacggattgcttgcactgcagcacagagggcaggaaagctgcggtatcgctgtgagcgacacctcaggcccgaaggggaaggttttaagcgttaaggatatggggctggtgaacgaggcctttaacccggagaacctggaaaagcttaagggggatatcggcgtcggccatgtgaggtattccaccgcgggcagcagtacgagagaaaatgcacagccgctggtactcaattacgtgaaggggacactggctctggcgcataacggaaatctggtgaacgctcccgaacttcgaagggatctggcatacacaggcgctattttccagacaacgatagactcggaggtcatagcctattacattgcaagagagcggctgaattccaaatccgcagaagaagcggtggggcgcgctatggggaagatcaaaggagcttattccctggtcatcatgtctccccgcaagctcataggagccagagatccttacggcttccgcccgctgtgtatcgggaaaagggataatgcctatatactgacctcggaaagctgtgcccttgataccctgggagccacttttgtgagggatgtcctgcccggtgaaatcgtgacgattaccccggaaaaggggattatatcggataccagcatgtgtatttccaaagaagagcatgccagatgtgtgttcgaatatatttattttgcccggcctgacagctatattgacggtgtgagcgtataccattccagaatcctggcaggaaaatttctggcgatggattctccagtggaggcggatattgtagtgggtgtgccggaatcaggaaactgtgcggccatgggatatgcgctgcagtcgggaatcccctatgggacggctttcgtaaaaaatgcctatattggcagaaccttcatcaagccgaagcagaaaaccagggagagcagtgtccaggtaaaactgaatgccctgaaggaagtggtgaatggaaaaagagtcattatgatcgatgattctatcgtccggggaaccacttcggacagaatcgtgcatatgctcagagaagccggagcaaaggaagtgcatatgcgtgtcagttcccctccctttttatggccttgctacttcggaacggatgtcccggccagagagcagctgatagcctataaccgcagtgtggatgaaatctgtaaaattatcggggcggattccctggcttacctgcgcacggagcgcctggatgagatggtaaatgaactgggcatctgcaaaggctgttttacagggaaatatcccatagacccgcctgaggaagacatccgcggagaatttgataaataaaacctacaaaaggagttgccggattatgagtgacaatacggacagatatgtaagcccgctttcagaaagatatgccagtaaggaaatgcagtatattttttccccggatatgaaattccgtacatggagaaaactgtggatagccctggcggaaacagaaaaagaactgggcctgcccattacggaggaacagatcgaagaattgaaggcccatgcggaggatatcaattatgatgttgccaaagcaagggaaaaagaggtgcgccacgatgttatgagccatgtgtacgcttacggcgtgcagtgcccgaaggcaaaggggatcatccatctgggtgccacctcctgctatgtaggggataacacggatatcatcgttatgacagaggccctgaagcttgtaaaaaagaagctggtcaatgttctttctgagctttcttcctttgcggacaagtacaaagaccttcccacgctggccttcacccatttccagcccgcccagcctactacggtgggaaaaagggccaccctgtggatgcaggagttctttctggatctggaagatctggattatgtgctttccacaatgaagctgcttggttccaaggggacaacgggaacccaggcttccttcctggaactgtttgacggaaatatggacaaggtgaatgccctggatcccatgattgctgagaaaatgggctttagctcctgctatccggtatccggccagacctattcacgtaaggtggataccagagtcctgaatgtacttgccgggattgccgccagcgcgaccaagatgtccaacgatatccgtctcctgcagcacttaaaggaagtggaggagccttttgaaaagagccagatcggttcttccgccatggcctataagagaaatcccatgcgcagcgaacgtatcgcatctctttccagatatgtgattgcggacgcgcttaatcccgccattacctcggcgacccaatggtttgaaagaacattggacgattccgctaataaacgcctcagcgtgccggaaggcttcctggctgtggacggcatcctggatctgtgcctgaatgtggtggacggccttgtggtatatcccaaggtcattgagaagcgcctgatgagcgagctgccgtttatggctacggaaaacatcatgatggatgcggtgaagaagggcggagaccgtcaggagctgcatgaaagaatccgtgagctttctatggaagccggaaagagggtcaaggaagaaggcctggataataacctgatggatctgatcgcacaggagcctatgttcatgacaaccccggaggaactggcaaagaccatggatccttcccgctatgtgggatgtgcgccggcgcaggtggaaaacttcctgaaggatgtgattgctccggttatggaagaaaacaaagagctgctgggagtgaaggcagagatcaacgtataacttttttgtgaaccggataaaaggtgtaaaaagctctgcttatgcagggctttttctgcatattgccagaaaaaaaaggggaaatgctgaaatggcatataaacaggaactgtggcaggaggcaaagaaacggtgccgtttgggagatgaggaaatccgtatggcgaaggagatgggactgaatccgaaaagcctgatcaaaaatattcccggcccaaaggaaagctggaaggcgccggttaaatactggataagggatatgtatgaggaaagacagataaatgcggcacaaaagccgaaaaaggcggaaagaagtatccttctttttccagaatttcaaaacatggagttgattgaaggaataagaaaacaatatgacccttttgtctcgttgatcagcccgcatattacattggtttttccttttgtcagcagatataaagaaaaagatgtgaaagagctggtaaaggagaagagtaaggcattttctcccttccggctcagcatgcagggaatcgtgaaataccaggagaacggggagcaatatctgttcctgcaggtaaaggaaggcgcggaggaaataaggcggctgcatgacagcctttatcaggggatgcttgccgcctttaaaaaggatattccttatgttcctcatatgacggttggaaagctgtcctctgccgaagaacttgatacggcatgggaacaggtaaaggatatgaatgtggtatttcaaacagagataaagcatattactgtggaaaagatcggagagaagggagaatccattacagaagcggaaataccgctgctgtaactccactcctgtcacagagttttgttaagaaactccagaactctttgggacatctcatcctgataaaattccatgcccatatgcgcggcaccctgaatgcggtaatactccacaggcacatggttttgagatagtatccgataaaattcatcgcttccggaaatatcaaccagcgtatcgcccgtcccgtgggccaggaaaaagggtaccgtattttcgttaatataatactgcgctgccgtttttgccgctctttccggttctgcttcaggatcgaagcccagaagctggattgtgcgggaatatcctgccgtatcggtcagcggaataccgtccatggagcgttttcccggttccttaactaaaacggcagggccgtaatagttgacaacggccgaaacatggctggattgttccggatattctcccacgtcaaaagcggcgatatcattggtgacaccaaccatggatgccaaatttccgcctgcagattcgccgccgacggcaaccctgtccgggtcaatcccgtattcatcagcgtgtgcccttaaaaagcggatcgcttttttcacatcttcgatctgcgcaggaaaatgagcgctgtttgacagccggtattctacgcttgccactatatatccccgttttgcaaaataggtaagccaggggatataagcggaacgctccattgttgcgaaaccgccgccgcagatccatacaaacagaggcctttttccctgaccggggcttccagacggagccaggatgtccattttcagatctttataattatagaaagggaaccagtagggaacctgggcaaaggttatgccggaaatcagagtgacgggctgctcctttaccggaatatcaattttatatctcatcattatttcctctctttcgtttccatttttcccggataattagacaggcagatgaacctgtatcggtatattgccccggacattaatgggtcacctctctgcgattgcatattccatccagaaatcccatgattctgtcagccatttccgcctgataaaaccggggatcggcatgtcccgcaccctgaacagcgcagaactccacaggtacattattcatttccagtgcactgcagagtgcctcactgttatcaattgatacaacgaaatcctcggtgccatgagcgataaagaaaggaggcgcggaaggactgatataagaaagcggcgccgcagtatccgccttttccggatcgtcggaaggatcatatccgagaagcatatttacaggcgacggacctcttaaaaaatccggtatttctccatccgcctttacccgtgtatctttaggattccatgtaaaactcgcaggcccataataatcaatcactgcctgaaccctgccggactgctccagatattcccccttatcaaattccttcctgtcgccggtaacccctgccatgcaagccagatgagcccctgcggattctcccccgattattactttttccggatcaatcccgaattctccggcatgagccttcagaaaacggattccctttttcacatcctccagctgagaaggaaagtgcgaacagtttgacagacgatattccacactggcaatcacataaccgcttcgtgcaaaattcataagccagggaagatgcgcaccgcgttccattgtcaaccaggcccctccgcagacccaaacaagaagcggccttttttctccctttccggggctgaagggcaaaacaagatccatcttcaaatccttatagtcataaaaaggaaaccagtaaggaacccttgcaaacgtgatacccgacagcaaagtgagcggagtatcggtcaatggtacgataatatcttttttcatgagagcctccttaaacttaatttgatttacacaaccttcgcgcctgcgtctgcgcccgctgttatctgcctgccctgtttgaaaggcccttccgcccctttgccgggcaaggccatgcatggatccttacaggggacgcttccgctcggataatcacgcagcggtactaaggctgcaaaatacgcagcctaaggaccggcgagcttataacgccccttacaggaacccatgtatggccttgcccggcaaaggggcggaagggcctttcaaacagggcaggcagataacagcgggcgcagacgcaggcgcgaaggttgtgtaaatgatactttaattataaaaatgatgccgccatgaaaacagaacaaaactgtttccttttgacagtattgtgtcaattgacagcagaatcgttcttttttcaaaggattgcttcccataaaatgaatataacatcagatgaacagttccacagtgcaattaagaaagagaggaaaatgatatgagaaagaaagtgttagcattcatgctcgctgccatgatgacggtcggccttactgcctgcggcagcagttcagccggtacggacagtccgtccgcagcatccgggcaatccgaagcggcggattccggcagttccgaagcggcggatgcggcggcaggggatctttattttgaagaactgcagcatttgattgtggcctttcctacatggacaggcgcgcctgcggatacggagatggtcacggaaaaagtgaatgagattttaagagagaaatataatatcgaggtggaattccaaatcagtgattccggctcctataagcagaatatgacgcttgcgctttccagcggggaacagattgatgtcctgagtacattgttttcaagctattccaatatggtaaaccagggttatctgatggatctggaagaggatgagctgcttcagacctatggccagggaatcatcgatgtgctcggccaggaatatattgatgcctgcagggtaggcggagttctctatggccttaccaatacccgtgattatgcggcgggccgcggctgtattgcggtcggcaccgaatatctggacgcgattgggtatgaagctcccgcagatgccggtgagatcataaaaatcacggaagatgagctgaatgatatttttgcaaagctgcatgcccagtatcctaatcttgaggtataccgccctgcggcaaatgacctggttcagcagaccatgatcgatcagatcggcggagataacttcggtgtccttcttgggacaagcgacgatcttaagattataaatttgtttgaatccgatgaatatatgaatttctgtaagagagtatataactggaatcagcttggctatataagcaaggatgccgcagcagatactacgaatgtcggcaccctggtaaaagaaaatgttctgatggcatatggcactggcggcaaaccgggcagcaaggttcaggaatccaccggtgacgggcgggatatgactatcttccagaccagggaggattatatctcttcctcttccatatcaagctatccctgggtcatgcctataactacggcaaatcccaaagcatctatgattctgttgaatgaactgtacaccaatccgcagctggcagatctcattatttacggaatcgaaggggtacattatgaaatcacggaagatggtttcctggacgccaacgccggctcaagccagggtacctactctacattgaactggctgtatcccaatcagttcgccagcacggtcctggtgggaaacactgcggatctgtgggaacggacggaaacctttaacaatgaagccattaaatcccctgccctgggctttgcctttgacagcacgaaaatagcaacagaactgacttcggttacaaatgtatatgaagaatatcagaaaagcctggagtacggcttcgtggatccggaagtcggaattcctgaaatgctggaaaaaatgaacaatgcgggccttcagaaaatcatcgatgaaaagcaggcgcagcttgacgcctgggctgccgcaagataagatgtaacagaaccaaaagaggggaccgatgaagcagaagcttcaccgatcctcttttttgaattgtcatgcagaatccttatctccggaactcccttggtgttacccctgtaaaacgcctgaactgcctggaaaagtaagatatattctgaaagccgcatctggtggcaatctcactgatacttttgtcggttcccgccagcatccgtttggcttcttcaatccgttcataaataatataattggtcaatgaaaagcctgtctcacgtttaaataaatgagaaagataatccggcgtaagatataccattgccgccagtgattccctggtcaaatcctgctccagatgtgcatggatataattttttatcgttgtgacggcagcatcctgattcgatgcgttcataacgtattcctcatacagcttcagcacggcgtttaaccagtcccgcaggttctgaacggaggagcaggccttttcaacggaaaactgcgcgatttgtttttgaaacagagggagagagtctgtgttggaaatctccatacagctgaacagcgtctgcagaaagctgtaatagaaattggagagggtatcccgtgttatgctgtgggaatgctgcagcgaattcaggaacatatccgtttctgacagaagatttccgattttgcgggacagcagcagatcactccagcgtttcgtggaaaagtccacatcggatcctgctgcctccgcattcgtgaactgtgcgaggtcaaacacatgattttcccgggatacatttttcatcgccgcatcctgcaatccttttattgtctcctgaaaatctgaaatcctgcaacccgaagcggcgatataaaagttgaacgtattgggaaaacgggggacaaaatctgtcagcgcctgcacgcaccgggacagcagcgcttccctgctgcgtcccgcttcgggcagcggcaggaaataaaattgcctgctttggcgcacggccacagggatttcctctctgttataaaaatattcccgcacgatatttttcagcagaaattcatgcaggtctttttccacggggagtttgtccatgccgttacactggattaaaagaacaagataagaaagatcggccgcggcaggattcagattccgaagattcagttcgctgatgatatcctctttcctgttggaaacagctccttcggatagatccagccagaacagctcccacagataaagctcactttccttccagtaatttgcctgctgtgtctccagctttgcattcgcctgctgacgatactggttcaccgcctttgaaaccgcgctgagaagatcctcgtccgccaccggttttagcagataatcaatactggtcagcctcattgcttttgaaatatattcaaacttggcataagcggtcaaaaaaatgcagatggtatccaatccctgctgacggatatgatccaaaagctccagtccgcttccgcccggcatttcgatgtccagtatcatgatggcaacactgtgacctgcaagatattccaatgcctgagtcatattataggcacagaatatttcgtcaaaaagcggccctttctgcgctatctttttcttggtgccttccgcgctgtaatattcatcatccacaatcagtaaattcatttttcctccccttttctacaggccctgcttcgctgtatcttcatacggctgatatgggaactcaatatctatctgcgctccttcatcgggacgattgctgaatacaaaccgggcgtcaggaaaaatatgacgcattcggaaaatcacatttgttattccgatatgcgaggtgtcaccggccgatggataagtgggatccgttatcctggcaagcattttcggagagaatccctttccgttatcccagatacagatatgcagccggatttcgtcatttgtttcatatgaggtgatatctatatgcatttccaggactttccccatcacgacttcgtatttgattgtattttcaatgaaatttaaaatgagcagcggcacaataaccgcctgacggaatgcgtcagggcagtttgaataaagagccagacagcccggataccggattcctgacatctccacatagttttttaccaaatccagatcttcatgcaggggtacggtctgaccggaagacagggtataacgcagatgcctgctgagatccataagcatggaacgtgacagatccagatgctccggctccgaaagctgataagccgtattcaggcagttgatcatgaaatgcggtgtgatctgctgctttaaatactgattttcaagctcctgatactggagcttgtcttcgtagacatcgattttcagattttttatttctgtaaccatttcattaaaggtggttgacatctggcagtattccttgagctgccctgccgtggaaatatggttttccaggttgccacccgatacttcctccagggcgttcgtcagatttgtgaccggccggatgatctgtctttttacaaaaaagacaagggataggcagatgctgagaaacagtgccgtcgtaataaatgcatcacggtttaaggaggcattcagagcctgaacttcagagtagggtatcattcttgtcagataaagttcgccgttagaaagaggctgctgcacgatcagcattttctgaccatcaatatttttaatcccgtaggtatcggtaagaatttcaaaattcaattccacggattccgttcccgggccgtacaaacgattttcaggggtggtgagatacagggccacctcatcggaatccgtgtttgtgagagaacccagcagggaactgacgccgaccagcgcaccgaggcgggcccctcctatattgataaaacggacaagataacaggagccgtttatctctgtgatttcccagtcccggaaaatatcatccccggaaatcacatcccgaagtgtgctctgcatagccacactgatatttgcgatctgattggagaacagaaaggtatcgttggcaggaagataaaacagaaatccatctgccgtatacaccgacagcgcgccattgaaatttttattcagatgataaagtgaactgtaccaggaggtggaaccgaagtccttgtaaatcaggttcgtataatccgcattatcaatcgcaacggtataaagatatgtttctatccggtccagctcggaatcgatctgcttttgatacagaaccacagtgtcctgtgtgttatagtacacatggttcagcaggagggaggtggctttataattatggaagacgatgagcgcaagaaaaaacagaagaactacaaacaacagaaaaagcgtataggtgtttacagataactgctgcagtttctttttcatcggatcctccccttgtgcaggtctgttgcaacagagtactttatcagtgtagtcattccctaattaattgtcaagaaacgcggattacaatgtccggataataccaatacaagtcaggattgttgttttttgtaccgctgcaggcaggctataatcaggatacagtgagcggcaatgtgttttgctgccgccatattgcagcaaaatgacaggatatttggcagactgccttatggtaacgaaaggagcgtatcgatgacgatgtctaaatctaaagcgcagaaaatgaaagcggtcaggacagaccgcagaaccaaaatgacatggcggagattccgccgctatatccccatttaccttatcatgcttccggggcttgtttatctgttcattaataactatatgcctctgccgggactgattgtagcgttcaaacagtataatgcaaaaaaaggtatctataagagtgactggattggattcaaaaattttgaatacctgttcacgacaaacgatgcctgggtgatcacgagaaatacgatctgctataatctggcttttatcgtgattaatacgatactcgcaatctttgtcgcaatcctcttaagtgaaatgtggggtaaggcaaaaaaagcctatcagagcctggttttactcccttatctcgtttcctccgttatcgtgggttacctggtgttcgcgttcctgtctgtggaaaatggttttgtgaacaacgcgatcctgcctttgttcgggaaagaagggatcaactggtattccgaaccgaaatactggccgttcatccttgtttttgtcagcgcatggaaagcgataggttataactgcatcatttacctctcaactctgatgggtttcgaccgttcctattacgaatcggcccagattgacggggccacgaaaatgcagcagatccgatacataacactcccaatgcttaagcctaccataatcatgctgacgctgatggcgattggacgtattttctactctgacttcgggctgttctatcaggttcccatgaatcagggcgcgctgtattccacaacccagaccattgatacttacgtctaccgcggactgctgcagctgggcaatatatccatgtcggccgcagccggtgtatatcagtccatcgtcggattcatcctgattctggcggcaaatttggtcgtgcgcaggattgacaatgaaagcgcactctggtaaaaaggaaggtaatggattatgaaaacaagagaagataaaatattcaacgctgttggccatgctgtcatgattatactgtcggcagcggcagtcatccctattattctgatggtcatttcttccctgacctccaatggggcacttctgcgcgacgggtactctttttttccgaaagaatggagcgcctacgcgtacaaatgggtgttcgcctccaatggcgggatggtgctgaaggcttatggaatttccttcctgatcacagcggcaggaaccgcctgcagccttcttctgaccatcggcctcgcctatggccttgctaaaaaaagcctgccgggcaggaatatattcacgttccttgttgtgttcacaatgctttttaacggcggccttgtaccgacctacattaactatactaacgtcttccatattaaggataccatttttgctctgctggttccgtccttattgatgaacgcatttaatgtcctgctgatgaaaagctattttgtcagcagtgtgccggatgaaattctcgaagcggcttatattgatggggcgagtgaattccagaccatgagaaaaatcgcggttcccttgtcaaagccgatcatcgccacgataggaatgtttgccgggatcgcctactggaacgactggaacaacggctatatctatctggtaaaaaggaccgatctctacagcattcagaacctcttaaaccgtctgatgcagaatatcaacgctctgacacagaatgcgagccaggtggggaatgtgaatcagggactgtcggaaattccttccgtatccgtacgtatggcaatggcaacgctgggcattctgccgattgtggtcatctatccgtttattcagaaaaactttgtaaagggtatcactttgggcggtgtaaaaggataaaaatataaaggatgaaggagaaaagagatgggaagacagtataaaacaataacagaggtatttgattttggcccacatatcagtaaagtgatattgcatgtgggaagaagcctgaaaggtgcgaagctttctgatgatcagttccgggtttccgttaagcgcaccgccatgtcgggagaagattttgcctggcctgtatttatgggggaaaagcccgatgattccatgaaaggaacccggagaatcacagatctgtatgtatcggacgcagaaggcagctgtgttgaagacggagagtacattacactttgtatgtactgcgatcccagagagggtcttggatccatcatccgttttgacggaaattttaatgtaaccgtaaatacggcttataaaatagtccagctcgcacccatagaaaccggagcggataccctggaaggccttgtattcgacgaaaacggcgggaaccgctttatttacggagaacttctgcagactgcagtacatgaagatcccgaagtctctctggcctactgctattaccgtcccgaagaagcggacgctcataaggttccgctgttaatatggctgcacggcgctggggaaggcgggaaagagccattaatcgcggcgactggaaataaggtcgtaaacctgatttcgcccgaaatccagaagctgttcggcggcgcttatcttctggcgccccaggcgcctaccatgtggatggatgatggaagcggcgaatatacaaaggatggttcctccatgtatgtggaaccactggagcgtctgattgcagacttcgtcaaagaacatgaggatatcgatacaaaccggatttacctgggcggagattccaacggcggcttcatgaccatgaaaatgctgatccgcaatcccggcagatatgcggccgccttcccggtgtgtgaagctctggatgacagtgctataacggataaggacattgcggatatcgcacaaaagcctgtctggtttacccactcaaaggatgatccagtggttattccggacaagtgtgtggttcctacctataaaaggctgatcgccgccggagggaaaaatatccattttactttctgggatcatatcactgatcagaccggccagtattttaatgaggacggtacaccttatacttacatcgggcactgggcctggattcctatgctgaataaccaatgtaagcttgatttcgatgagcagcctgtaatttgcggcgggagacaggctgctgtcattgactggattgcgcagcagagactggaagaacagatgtagataataaaactgatatcgctggcagggcctttgcaggcagttataatttcatttgtaattacgaaaatcccagagtacattttaaaagtaaggtactctgggatcttatttttggttaatgacagccagcaaatcagaatgacagcaataaaaaaatttgcttttagtacttaagtatacgaatttaaacttttatgccgtatgtttttgcgcatcgtttatgtgattttccaagaatccatgtacacgtacgatttcatcaagaatcatatggtcatcagcgtgaaggcattgtaaatcaaccttaatatcagaaacatcttgttgaagaacagtaacatcctgcctcaattcagaaacatcctgttgaagagcagtaacgtcctgcctcaattcagcaacatcctgtttaagaccggtcatgtcttgcctcagttcagcaacatcctgtttaagaccggtcatgtcttgccttagttcagtaacatcctgtttaaggccattgacatcctgatcaatacctgttattttttctataattaaatcaagcttttcattttgtgtcataggttcagtccttcctttttataattgaatacaaatttaatagtaagccagaagtttcgctattcacatttaattcacaaagaagttaaaaaatcaaatccatcactaataagtatggtatcataataaatgaagaaagtctatctcattttcataagatttatattctgaatattgtgtattaggaaaagaatcttattgcctgcgaacagcagaaagggggactcatgaataaaaacgattatcttaacagctattacagtacttatcaggaggatgcccggctgacagccacaaagcatggtctggtggaatatcttacgacgatgaaatacatccatcgttttctgaataaggggatgcgtattctggaaatcggagccggtacgggaagatattctctcgccctggcaaaagaaggtttcagagtggatgcggtagaactgctcacgcataacctggatatcctccgttccaaaatggcggaattaccggatggcggcagcatcagggcatatcagggagatgcccttgatctttcccgttttgaagacggaacctttgacggaactctggttctcggccctatgtatcatttatacacggaagaagatcaaagaaaggcactgcaggaagcttgccgtgttactaaaaagaacggatatctgtttgtggcctactgtatgagcgatcctaccatggtaggagaactgtttccgcttggagaagtgaagaaatatctggaacaaaagaagcttacggaggattttcatatcctgtctgagtcggaggatctgtttcatctggcgcggacagaagatattgaaaagttggatggaaccatagatgcagaacgattaatgctggtggccacggatgggcctaccggttacatgcgtccggtaatcgacagcatggatgatgatacgtttgctctttacatgcgttatcatttcgcagtctgtgaacgcagtgatctgataggcgcgagtcatcataccctggatatcctgaaaaaaagataacagacaatgcatttcaccgcccttttctgcattctgccctgcttcttattgagaaaaaaatgctcccgttctatacttgcagcaggtcaaaatcctgcggatatttatataagctgaaccaaaataattttggaaagccttcgcaggaaataccggacaggaggcggctatggttatctattggtttatcggtgcttttttccttgcagaagcaataaaagaagggatttttgtatacagtaaaaggaggcttccgggtcttcagctgctcttcggcctcggggagctgctgctgtttctcctgttttccataataggagtatggggctggaggaattcctgtatttttccggcggcatttcttttgtggaacctggcaggggcatggtatgccttagtcaggaaaaggaggaagaaggcagggatcggaagagcggtgctccgcctgctggtattggcgttctgtctgctcccggtggttttattccctccgatgaagcctttggactaaaattccacaatatgtagcgtctgatgaaataggacggcacaagatgtagtgaaaagggcttacaactacaacttttctacaacttttgcttgaaatcagacggcttcagacgggccaaaatgaagggcaaatccgtgttttttatgcggatttgcccttttttgcaattttcacattagcaccaaattgcccttgattgcctctgctttttccctcatgttttcttgcgtaatatgcgtataaatatccatagttgtggaaaaatcagcgtggcccatcacttgctggataaacttgatgtcgttcgtgctttcacagagccgcgtgcagaatgtgtgtctcatgttatgtacgctaaaatgcggcagcagttccggctcacgatcttccagttcagcctgatccatttcttcggcgttgtaggcgatggagatacgctggatggcccggttgatattatgggcactgagaaagtaaccttcccgattcctaaaaaggaaaccgtgatacccattcatcacaaggtcttccggatagagggtgtccatgacttcaatcaatgtgcggagctgttcagcaacctgcggatacaggatcgggatggtacgggtgccgttggttgttttaggggtgttgatgtgaaaacctgctttcccatcaatcacacggtaaatcaaattatgattgacagagatggtgttgttctccagatccacatcatttttagttaagccagtacattccgcaacacgcattcctgtaccgagcagcacgaccatgacaggcagccagtggctatacatcggtgactttgaaatgaaacgaagaaagttcttctgctgtgtcatagtcagcgcgattcttttcttcgggggtgccccggccccctctgttttgagagagcgatagacgcccttgctgggattttttcggatgtaatcatcatcgaccgccaattccagcgtgggatggatcaggttattgatgctttccagagaattgattgcaaagccttttttcaaaagcttcgtgtaaaaggtcaggatgtcgctctttcggatattaggcagagggatgttagcaaacggctcgtccttcacatagttgttccaaagatattcgtaattcgcccgtgtagaagcctttaactgaattttcgtatccatgaggactttgaacatatcatttagggtaattttcatagcctcctgggtacgaataccgtcatcgctgtcacggttgagcactttttctttggctcgcaaactggcaaggtcaaaatcatagatgtactttttctttttgcccagtttatagacaaacatatagctgccgtctgagcgttgtgtctctcctggccgcaggttacggcctttgttgtcttttctaacttttggcataggctgatacctcccgatgttttgtgtgttgctgcgcccggaatgggcagggcgctgttagcatgagatctcgtacaagtattcctttactcgctgaacgctccaaaggacacgagaattcatggtgatgcgggcgtgggccaggtcgccgatctggacggccgtgtgccgcccgcagtcgagcagtttgcaaagcgattctgtatcgaccgccaagcactgatctggtgaaaggtcattgggttttcttttttccataattgccctcctttatttgcaattacatatatcccctacgatttgtaggaaaaggttttcaacaaaaacaatgaagtcacttaaattcatcgggaagtgtgaaggctcttccatcgtccatttcctgcgccggggctttccgccgcgtattttcaggctgccgctatgcgacatttaagttgtgggcgcgcacaaacacactatccgcatctcctgtataactccgataaaagaggttatgagaattgtcaaggtacaaaaagagcgtgcggactggctacgaaatccggcaccatgtctgtacaccctataaatagggcaagaaggctgttttttctgcacggcctattttttgtaaaaaattttttctgttagactatatatagacatttgttcttgactaaatcaatatattgtgttatcttgttcttgtaattgatttttgtgcgttccctatatgggatacagattttgtatctgtacggcaaggctcaaagccctgcattgcacacgcagttaagattgtatttgtgccagtagtattgctgcgcccattcgggccagtatattactggctttttttatttttcggggtttccccatcagcgaggatgacattggttcataggcaactatggacaacaggcgttttgccctttgtcatgctcgcttttttgtcgcccaaatgccggaaacggctttgaggatatatcaaactacagaaaggcaggtaacacgcatgaatgtaaaaaagcgaaggcaggagcctatggcaaaaaggaaatggcctttggaggactggcagcatcagaaggtgcccaaatccagccaagtccatagtccaatgattcgagtacacgctattccccgccgaacacggagggggtgctaaagatgccggcgagcaatgtagccgccgaaaagcgaagtcaaccccaaattttggtggaaacggcgggcctgtccgaagaggaatggcttgcataccgccggaaagggattggcggcagtgatgtggcggctctgctgggaatttcaccctggcggacggcaagagacctctactttgacaagttgaatatcgtagcggtcgaagataatgaggacaactgggttgctctggaaatggggcacctgttggagtcgttggtggcgaagatattccaacaccgcacagggtacaaggtctatcagatcaaaaaaatgttccagcacccacagtattcgtggatgctggccgatgtggactattttgtggaattgccggatggcagtaccgcaattctggagattaaaacgacaaattataacgcaagggataactggtggctaaacggtgaagaaaccgttcccgtctattatgaagcccaagggcggcactatatggccgtcatgaatgtggaccgctgcttcttctgctgcctgtatggcaacaacgaggaagaaaccattattcgtgaaatccggcgggacgagtcctatgaggaggagatgattttcctggagcagtatttctgggaaaaccatgttcttaccaggacgccgccgccctataccgaagatggtgatctggtgcttgaaagcgtgcgccggcatacgggctctgcagatcaggacgctcccgttgtaacgcttgatttgagcctgacagccaaattgatgcgctatctccagcttcaggagcagaagaaactcacggaagcgggcagcaaagagattgaggcggatatgaagcggctgaaggcggcgctggtcgcagaaatgggcaagagctgcaaggccgtttgccaacaggatggggtgaactatattgtcacctacaatccagtgagaaagcccggcattgacaaagacaatctgatgcggctgaagctggaccaccctgatatttacgagcagtatgtaaccgtttcagaatcccgaaggttcagtgtgaaaattgataccaaggcggcatgagaaaggaggaaaatgatttgatccatagaggaacttatgatgggacaatttaccataatcctgcaaataagttctgcatcatcagtgtaaaaactgcggacaaggatgtacctcaagaagccaggtctacccgccggcacaaggatcatctgattcggtttgtggctaccggctacgaactgccccgcacagatgcggtagaactggaactggatggcgaatggaaaaaaggaaagtatgggatgcagcttcaggtggagcagtggcatgaaattgtccctcaaaccaagagtggagtggaaggctatctggcctctggccttatcaaaggcatcgggccggcgctcgccaaacagatcgtatcacgcttcggcgtggagacactggacattctgcaaaatcgcccggagcggctgctggagatcaaaggcatcacggagaacaagctggaggccatcaagacctcatatgcagagagccggatgctgcaagacctgatgacgctgctctccccgttcaagattacaccgaaaacagcgcagaagatttatcagtttttcggcccggccagcgtggacatcttgaaaaagagtccgtttgagctttgccaaatatccggttttggctttttaagggtggatgccatcgttcagaaaaacggaggcgacctgcgcgcccctatgcgaatcaaaggcgccttgttctgggcgttggaggatagcaaggggaaaaacggacatttgtttttgaccagtgaggctttacaaaaagaggcgctccaattactcaacgctaaaatccctattccttcgcttcggctccatgcacaagaggtcagcgatgtcctcgaagatatgatcctgcatggagaggtcgtatccgtcaaaggaggcatttatcttcctcgtgtatttgcacaagaggatgaaactgcccgccggattgcgatgcgtgtggtggagcctcccaccccggagaagatcgaacaaattttggagcaggtcaaacgagaaatcggactggccctgtcctcaaaacaggaagcggctgtgtatgcagcctatcgtcacaatctttccatcatcacaggctccccgggtaccggcaagacaacggtgctgaaaacaattctggaggtttaccgccgcctgcatccccaaggagagatcgccttaatggcgccgacaggcagagccagccggcgtatggcggaaagtaccggggttgataaggccaagacgctgcacagcattttggggctcgccagcgaggaagatgaaataaaacgcaacaacacccaagagccgctttcggccgatttgatcattgtggacgagttttccatggtggatatgtggctggcaaataaatttttctcacgcatcaaaggtggagcacgggtcattcttgtcggagacccggatcagcttcccagtgtaggcgccgggaatgtgttccgtgaactgattgactgcggccttatcaccgtgacggtgctggatcagattttccgtcagtccaaggacagcctgattgcctacaacgccaaattcattaacgaaggcaacaccaagctgtactacggccaggatttcgttttcatggcaagcaacaatcaggcggaagccgctgaacgaattgttgcccgctactgccgggagatcgaggaaagtgggattgaccgggtgcagattctgtcgcctttccgctcggacggcgcggcctctgcggaacagctcaacgaagcgatccgcgaagtggtcaacccgtttcgttccgccgaggaagaaatcaaaatcggcgtcaaggtattcagggtcaatgaccggatcatgcagaccaaaaacactgccaaggtatccaatggcgacctgggattcatccgctatatcaaaaatgatgaagatggaactcgcgttggacttgacttcggtgtgggccgtgagttggagtacggcatagaggatatggtcaatctggacctcgcctacgccactacgattcataaagcaatgggaagcgagtacgatacggtcattatgccgctcttaaaggcacatactgtcatgctctatcgaaatctgctctacactggcatcacccgcgcaaaaaagcgtgtggtgctcatcggtcaaaagcaggtattgttcatggcaatccatcgcaatgagatcggcaaacgcaacacgcttttgggtgaacgcatccacctgtactataaggcgtatgcccggcgggcaggtatccccgttccggcgaacttggaaaaagaattgaagcacgcaggctaaaaatgtgacgcaaggtgcagaaaaacgcccagcgtcccctatttattatacaggaaggagtttagaagatgagtgacaacaacaataatgcaaaaacgatgtacgaggccgttcctgccgctgcggaactgaacaaggtaccggggttcgacccgctgaagttcctccggcgtgccggggactccatgaaattggacttaccctatcagaaactctggttccgaatggcacaccccaatgggcgtatgcgtctgacggccatgcggatcacggagcagatggcgatttttgaggccaaggtatttctggaccgcagtgacgcggagccgttcagcgtgagcgttgcccagcagaccatgcaggatagcagggactttgtgaaggcagctcaaaatgaggcgttgagccaggccctttcggacgccggatttggcatccagcttgtgagcgccgacactcatgccgcttccgtacagaaagcggcgcctgtgagtaaaacgcagccctctgccattactccgcctgtgagcactgtgttgccgcaggagccctccagcgcctcgcagaaggccgctgttctttccgagggtaattccatttccgggggcacacaaacgccacagagggcatctgaaaacgcggaaacagcaagaacgaagattcagcccgcagaaactccagccaaggggcagagtttgccggtgagccctactgcaaacacggatacactgccagcgggattcgcaccaacggaagaacagccggaaaacagtaaggcggcggaggaattaccaattcatctccctgcggaggaactgccagttcagcgccctgcagaggatctgacggccaccaaggaggcacaggaggtcccggaagccgaaatcgtgcaagaggcccctgcatataccccggatatgcctgtagaggatattctgaaggtgatgacgctggaacaggcacaggaggtcgttgtggacagcggtgtgtgccgggggctgactattgcagaagtggcgaagaagcggcctgtcaatctgcgtttctatttgactccgggcaacaaaagcaaggacaacatcgttcgggctgccgcccagctggtcctcaattcacttcagaaggccggttgatgcgaagccctggctcgggtatgaagggaggaatgacaaatgggctcatacccggatgaatttcctttcggcatcatggaagttgtcaatctattaaacctgcgcatcaggcgtcaacaggcgaacagcgtctatgtggactgcccgttctgcggtgaccgccggggacggatgaatgtcaatttcgtcaagaatgtctggcggtgcaaccactgcgatgcacatggcggaatgctggcgctgtatgctgaacttaaccatacgactacatccgatgcctactgggagattgcagaagctctgtgtgacaatatccaagaggaacacgcacgctccgggaatgaagcccaacaacggccggccagcccatgcccttcaacttcgggggcctgggctgcccctgccggtcattcttcttccgagcgaaaaacagtaccacagtcgaataaggccagtccagcggagatccaccagacgctatccctgctgcttgctcaacttacgctgcggccggcgcatcgggagcatctgcgctcccctaaacgcgggctgtctgatgaacagattgacgcactgggctttaagagtaccccaccgccttttctatgccggtctattacagaacggctgatcaagcagggatgcaaggtgcagggagtgccgggcttttaccaggatggcggtggacattggactatggctttttgtcaaaagacagccggcatcctgatccctgccatcggctttgatggcatgttgcagggattccaaatcaaactggatataccgctgaaaaacaaggatgatccgccggaaaagccgggagcaaaatatatctggttttcgtcttcctcaaaaaagaacggaacaggatcgggcagcccggtacatctggtaggaaatccatctgcccgtgtcgtttatgtgattgaaggtcttttgaaggcagacatctcctattgcctgaccgggcgcactttcgccgcgattgccggcgccaataacaccagtccgttggacgctatgttcgcgttgctggcgcaaagtggcacagaggagatcatcgaagcccacgacatggacaagtacagcaacaaaatgaccatggccggggcatctaaaatttatttaatggcgcaaaagcacggcatgaattgccggcggttgacctggaatcccaattataaagggtttgatgactggcagctggctttgcgccagggcagtcagcggcaaaaggaaattgaaaagttaagtttcaaagagcagtatctgcgcgggctgtgcgagctggcccacattgaggactgcgtggaacagtggcagcaccgggccgagcaagacatcggactgacagagtatctggggctgacgggggaggaacataaaaccttcctgtgcggcggccgggacgctcttgccgccctgttggagccacagcggcgaaaacaaaggtttgtactttatcaacttcaactggacgaagagaacgcgatcccatttgctttcaaggatattacagcgttaaaagcggctggttatgaacagccgcctgcggcgatgtactatgtggcaggaagtggagaaatctactgcccagcggaggaatcggatgacgcacttttgaagcgcctgtttgccgactgccgggagcggctgcctgaaggctgccgcgggcggccgatggcgatttctgatgtagtggaactaaatcatggtaccaagcgggcgtattattatgtaagcggacaagaccagtttagacaagtaaagttttcccctatgctcgcaaagaaggaaattccagaaaagacataagagaggttttgatggttgtcgtgagtgagacaaaggagagccagcttttggcgctcctggagcaatgcgtccatctggacgctgatgtgcggccccgtaaagaaaaaggcttttttacggtgacggttccgccgccgtggaacgatccggcgcgcagggcggctcaagcaatacaggatcaaatcaaggaatggtcaaagcaatatccgaatgtggtgtgttactgctttgacggttacagtacattggtttatgtgctgtaaaagaatgtggcaaaggcatgggatgggcattggcctgttccgtgccttttttatgaaacgacggaaaggagatcactatgggatatttttcagaaatggcgctgaataagcaggaggagctcggacttcccgcagaacaggtatcggctggaaacgcctttgaggatgaggaaacttttgacgagctgccggtgccgtcggccagccgttcagcggcttcccctaccgtggaaacgccgccatcgcccgcatttgatgcagacgatgaggccgaggaattggaagacatgaacggagacaatgcttccgaggcagcggacacggatggggatgatgccggtaaagagcaggaggcgcccgccaaggccgatgcagccaccgatgcggacgaggaaaaacgccgtgccgagcatgaggcggctgaagccaagcgtaaagcagaatgggaagcccggcaggctgaaaagaaaaaggccgagcaggagcagctggagcgtctggccgcgatgagcgacgacgaggtggtgaacgcctccatgcagcgggtcagcgcagatacagaaaaactgacccggcgcaacatgaaggagtgtgtggcagaatttatccaaaccaagtgcctggaggatattactttcgcacgcctcaccatgcacccgcgcaagtcaatgatccactgtttccagtacatcagccgcaaggcgtgggactacattcaggatgaactcaaagcaagcggcattcagccaggtccgggcagccaagggtatggctgtgatgttccggacgatttgtgctaccagtgggcagaggattatttccgcgacccagacgccaaagaggatcataaggaagaagaaaagtttgtaccgaacccctactatggaaaagatttcgccagaaccaccaaaaagaagcagaaggaaaagaaaaaggcagaagccaaaccgaagcctgtgcagaaggaaaagcctgccaacgatggtcagctgtcgctgctggatctcggcatgacaaaggcaggttaagggggtgcagcatgattgcatataaaggatttcttcccggcctgatttgcagaggttaccagttcaggatgggactcaatgtaacggaaaaggccaactgcgctcataatggctttcactgtgctgaggatccgctggattgcttgcgctattacggagatataaaccacgcagaatactatattgtcgatgctggcggagacattgacgaagatggtgtcgattccaaaatttcctgtacagagttgacaattttgaaacggctgacaaaaaaagaactcttcctccatggccttgcttttatggcagaccacccgaagcggaagtggaacagcaatataaaggcggacaaagctgaagcgtggaatggctatgcagcggtgcgcggcgccgaccctattgcaaaagggactcggaacggagatgtacttgcgtttgcaaaagaggacggcactaccggcggcatccagcagatcgtggtggcggagatcgacgggaaaacgctccaaccaggaatttggtatggagtggagcttgaaaaaaggatggtgaactaaattgaagaaatctgcacttctggcaatgccgaaattgacggcaacgccggagatgaaacaggcagcaatagcagatgagccgaaacagcatgaaaacccctatggctatcgctatgttgaacggacctactatccatatatgaactgtgtcgttcaggatggcatcctcaaagcggctttttatctgccggaacatctgcggctggatggcaacaatcctgcttatgaagtgttccttgacaagaaagcgcaccagtttctgacttacgaccatttagagaaaaaatggcgggacgccaaactggacaggctgaattggccggggagaaactattatgccacctgctgggccagtgagaaagatgctgccgtagtacaggactatctttgtggggaacgcggcggtgatctcggtatccttgattttcagagaaatgtacgggacgaacagttggagcagaggcataaacgaattaccggcgcgtgggatcaggatctggctcaggtgcctgaactgcccaaggattggatgcgctggattgataaggtggctgtgcgggaaaatttcatcttctatcgctataaacgcggcggagcccaaaacggttattgtaccttttgtgggaaagaggtccctatatccgggcatccatatcacaataagaaaggacgctgtgcctgctgccggcatcccattgtattcaaagccctggggcgcgccgggtatattcggacagaaaaggactatgcttatctgattcagcggtgcaaggatggctttgttctccgtgaattctgggcagagaggacttactggaaagacagtctgccctctggaaagccttactggcatgagtttcgccgttcgatttatgaccgcagtggagaaatacgctcttactattggggcgtgtattgccagcgggaaacacgctggatttccggtaatccctgctactatagttactgtggcaatcagacaggcagggtctatggcaagagccttccctgcatggaacagaaggagctgttcggcactggccttgtgcagtggatacgcacccatccggtgactgatccggaaaagtatttggctgtttggaagcggatgccgaagatggagcagatttggaaggcagacttgccgaggctgacaaaagaatgctttgaacattgtgattctgtgcgggaacggatactctatccaaatgagacgcgactgattcgagcattgggattagacggccccaaattccgccgtctgcggcagataaatggcgatacggaagacctggcatggttgcagcttgaaaagcggaccaatcaacgcataccggatgaactgtttcgctggttaaaaaaagaacggatcagcgccaaagatattctgttcatcgcggaccgcatgagtccgattcagatccgaaactatctgcaaaaacagaagccgtattttgacggaagttgtcggcaggcgttgaccacatggcaggactaccttgctatggcagagcgtctgcatatcgacaccagcgatgaaattatctatcgtgcgcgtaaattgcgtcagcggcatgatgaactggttatccagtgtgaggctggaagcctggagcttcaagcagagaacatggacaagaagtacccccatgttcgctccatctgcgaggaattgcagaaaaagtatgcctatgcagatgaagattatctggtcattgcccctcaaaatacttttgatattatcaaagagggacggatgcttcaccattgtgtcggaaatgacggcgccggcgaacggtactatgaccgcatcgagcgccgggagagcttcatcatgtttctgcgccgagcggaggaaccagaagatccctattacacactggagatcgagccggacggcactgtgcgtcaaaaacgcacgctgtttgaccgccagcacgaggacatcgagcaggcgacggaatttctgcagaagtggcaaaaagtcattgcggcacggcttacaggccaagatttgaagctggccgcgcagagccgcgtcctgcgcaacgaggagtttatccagatgaagaaagatcgggtggtcatccataccgggcaccttgccggccatttgctggcagatgtgcttttggctgacttgatggaaaacaaagaaatcgtgcagcagcaggagctccctgcggctgcatgatacaggtgcaatggccgggcgtcctttgagggcgtccggccaactgttgcaaggaggctttatgagaaaaacatcttttgagtaccacatccacggttaccgctatgcaccggagagcttccacatctataaaggactgccggggcaggaaaagacggagctccccctgtcggatgagcagcgttatcagatggggtatctttatctgacacagggcatcaagagcgccgtagactatgtgaagcatatcgagcgggagcgggaacgcaagtgccgcctgtatatgacctacggctttatgctcaaagaaaatccgtgcagttatgtgtactgtgcggacctgcgatgcagggagaacgacccgccggcggtgcgcctgcagaccctgcgcgcattccgggagcatctggcccagagcgaaggccgtattgagcagagcgtggagtgcgaactggatgggcgttaccgccctatccatatgcgaaagaattatgtgactgcggactttgaccggcccattgtggtctggctgaatatcagatagaaggagaagaaaatgaaacagattggaaatttagcaatcgtctgcgcccagcggcctgatgtgttgatgcagatttacggtgggaccgtgagcatccatgtgggcgaagggccggagcgggccaccctctccactgcgtgggaggatgacgacaccattcaggacatgatcagggaattaaactttgggcgctatgccgcccatccacggaagaaggaagaaggtgcagcatgattaaaaatttgaatcagctcaaacgcaggttgcggccgggcacacgcctggaggtcaccggccactgccggcccggatgcatcggccaactgcgggaggttacatgggtcaatacccagggtgtttacaccaaaatcctcaatccgcccgatccgcgcatcaatgcggcaaacgatggacggggctccataatgtggtggggtgcagccagcacctggtcatttgaggacggtgtgtgcagttcatatatgaatcaaacaaagacggcggaaacgctgattatggcgttccgcgttttggatgaggaggcggcctgatggaacagaatactttgagaaagcagcgggagctgaccgaccggctcaaccgctaccgcaacgaatactataactacaacaatcccagcgtcagcgatgaggtctatgaccggctctttgacgaacttcacaaactggaacaggagacgggcatccagatgtcgaactctcccactgtcaccgtgggctatcccgtggtaggcaagttagagaaaaccgcccataaaatcccgcttctttctctggataaagtaaaaagcagcgtggatttgtgccggtttatgggcgagcatcaggtgatgatcatgctcaagttggacggccttaccatcaaactgacctatgagaacggcgaactggtggaagcggccacacggggcgatggtgatgagggtgagattgtcactcacaacgccagagcaatcagtgggattccagcccatattcagtacccggggcgtctggtagtcaccggtgaggcgtttatccgtccccgtgatttcgagcgtctgaacacttcgatagtggatgagaatggtgaaacctacaagaatggccgtaatctggcggctggctcggtgcgcctgcgggatgccggcgagtgcatggaacggtgtgtgaccttcatgcccttcaatgttctggagggttttgatgacctgccccgcaagtcggaacgcctcaaagaacttcggccgctgggctttaccccgtgcaagtatctggtgacgaagcggccattgacgcaggcggagaccgaggacggcatcaagcagctgcagcagtatgcaaaagacagcgatattcccatcgatggcatcgttgtaacctacaatgatattgccttttccaaaagatgcgggcgcacaggacatcactataaggacgggctggcgttcaaatttgaggacgagctgtttaagacaacacttcgttccatcgagtggacgccgggacggactggtgagattgcgcctgtagccatctttgctccagtagaaatcgaaggatgcgaagtgacacgggccagcctgcacaatctgtccttcattgaggacttggagctgatgccgggcaaccgcatactggtcagcaagcggaatatgatcattccgcatgtggaggaaaacatggacaggggcggtttcaatctggaagcggcgttcccgcaccagtgcccctgctgcggccagcctacccgcgttcatgaaaccaaagggcgggatgaaaacggcaaggagcggatcatcaagaccctgttctgcgacaatgccacctgcgagacacggaaactcaaaaagtttgtccattttgtcagtaagaaggcgatgaacattgagggactgtccgaggcgacgctggaaaaactgattggccgtggatggattcacagctatctggatctataccggctggatcagcaccgggatgaaattatccgcatggagggctttggtgcaaagtcctggcagcgtctgtgggatgctgtccagcagagccgcaacaccacctttgaacggtatgtgattgccatggacattcccatgatcggcaacacagccagcggtgttctctgccgggagttccatggcagtcttgaagaatttcgggacgcggtttatacgggctatgacttccgccagctcccggattttggagagacgctgcacaacaatatccatgaatggttctgcaatgaagaaaatttttgtatttgggaggaattacagatgatgatgaacatccagaagccggccgcggccaacaatcaggcagtcggccaggacactccatttgccgggaagaacattgtggtgacaggcaaagtagagccctatacccgcgatgagatgaacagcctgatcgcctctctgggcgctgtggccggcagttcggtgagccgcaagaccgattatctggtctgcggtgagaaggccggcagcaaactgtccaaggcacaggagttgggcattcgggtgctgacgccgaatgagtttttcaatatggctggtgtggcttaaaagaaaacaggtcaaaaaataacaagggagagggctgcgggtgcggtcctccccttctttatcggcaaaggagatgtttcagcatgaaaggcagttactttgttccgcaggtgaggcaggtttatcaaaaccgaaatgacaggagttatctatgcctgtctgtggaaaaaaggcccctattaaacgataccaccgcacagatgcggcgaacttctgatggatggactctgacggctcatggtcttatccgttatgaagatggaacgattgagtggaattactctactggaggcagatggagcgaatcaaagtgaggagggagcgaagatgaataacgaatttctgccagcctacaaggtatatcaacaggccattgatcttgaactgtactatgcgtttgtagatcttgtcgtacacacctctcaagaagaaaaagcctgggagatctatcgaaatattgtggacacgcaaatctggcaacaaaaggaagaagaacagaattattttgaagcctataacctccgttaccccggcgaggtcctggaacggtttgaagagaagctgggaaaagatgtccgcattattcgtgcgttggcgctggcgctggggaaaacccgtgcgcttcagtcagacaatatgtttgttggaaatcagcgcggcagttttctccagatggtccgtcggacttccaatggagatgtgtacctgcaaggggctctttatctgttggaaacagatatgccccgccgacacgccctgctggatgaactggctgccacagaatatgccaagaccgaggatgccttgtttgtcctgtctctgttcgatgaccaggaggaagggtaccgcactatgcacagccagcttctccgattgctggggaatgaacgcacgctttccctgcctgaaaactgcggcgtgctggaatggctggtccagcattatgctccgtatatcaagtcgtatcgcggaaagccagatcttgttttgcgaacactgacgaagtttttcagaatgaacatgaaaccggacagccgggagttttcaatcctgacagacgccggctacagcggtcaggaaattatactgaccaattccctttgtgtgtgggcagacagaatccgggacaggatctcctggaacgggaccaccgcagaaaaaatcgcatcggcgtgctgccaaatgctcttaaaccaatcggatggactgtcggaagggctctatgcctatgttggatggttgtttggccgctatgaaaagtttgctgtccagtacaatgggtatccaaatctctgggaggcggtcaaaaaagaactcacaccatccgcaccgcagacaataatctggatgctgaaaaccatcaaaaaggaattcccgtatcgctttgacgcctttgacccccagtacaatattctggcaaaagaagtgccgcaaggcgattactgggaactgtttacagatcagatgctctgctcttgtggaaaaacgccaatcgttcaatggctggcgagataccgggaattaacgggcgtcgattactgtgatggctttcaggaatggcaccgttcctccgatagagcttttgccctgctggtagagagaaaagaaatccggctgtggcagttttttgaacagcatcagggagacggcccctctgcgcagccgatgaaactgctcttggggtatgccatgaatatctccagctggcagggcttccgttttgtacggcgtctgctgcagaaatacaccccagtgcagctccagaagttttttggggagcggtttttctttcatgaactttttgtaaggggtaatcggtacagcagcagagactatgagttttttatcaaacgctctttcctgacagaagagcagcatcggcagctctttgaatggatcgaggcttcttttttccaaatggagccgaaatgctatcaagagtttatctggtgcgctttacaagattcggatgtgcagcggctatacgacaggcggctgcttgcgtccgttttgcgaagccttttatccagcgggaagtacacaggtggccgtgcggaccatctaaaggaaaaattctacagtaaggaagagctggaagccgatcaaaaagccgacgctgaaaaagcggaacgggaggaacgccttcgccgggagcaggagcaccagaagaaatgcgaacggttggagcagacctatgacggtacgatgtcttctctaaaagagtttacaaaaagtttctattacgatagggatgtgaaagaagccctggatatggtgtacgaaaaactgcgggaacagcctgcaggctgtgcggcggcatttgaagcggacgaattagaacacttcttcaaactgtgcggtgatttggcacgaaacaatccaggagaagagcagaaaattttgaatatggcgagaacaatgatgggaggtcttgcggcatgatctatgcggaaaagcatttatctttgttgtcccgaatggagcgcgatgggctgcaactgcgtttcactggagaatttccagaagaaatactggatcagacctgtaaaaaaatcgaagatatgggcctgcaagagaagctccgcaaggaagaagccacgcagatccagagggaattgattcaagttccagaatttgcagaattgtatcaggccctgtgcgcacagggagtagaggtatctgtcatccatacgatgctccaatcggcaagaagctatcaggagcacttgtcccaatatccgaaggaacaggtgctgggggcggcggcactggatctcaagccttccctgaaatttgagtacatgaagcattaccagccgctggtgcggtatgaagaagaggaacgggccgttgcagacaacctggataccttccctgttctggagtggcaggaaatctctccgctgacggaacatcagcggtcaatgatgcggctgccgtttcttggcgcttatctattcaactggcacgaccatgagcggaaggctgtagagctgttggagcagaatctgccccttcagaaaatcctgatgatgaactatgtgtggggagtggagttgtttctggatgcggacagtctgaaaaatctcaaatggctgcaaatgccggatgtagaaaaattccgccgactgatggaagccttcgagtatgatgcggaagatttatcggaattctggacgctctggctggaaaaccgggccggacaatatgatgtcgaatggtggctgagtcagctgttgcccatcagcaaagagcggcggcagaaaatcctgcaaagcaggctgagttatctcaatgccctttacgctggctgccttcacatcaattttgaacaagtagagtattttcaggtccagctccttatctatgcggtggagcacaagaaaaagcattttttgaatctggtgaatcagaacagcgaactatttttctcgctggggcggtattcgctcttatttgtgagcggtttctgcgaacgctgtaatctcaattcgctgacggttaagaacttaaaggacagtgattctattgaacggacaaccagctactttgaacttttggaagagggccagcaatatacctttgaggaactgcgtctgctgtggcaccaagaggaagtatatgtaagactgtacgccaaactctccccgctctccgtggaccagaggatgctcacaatccggcagctgataaagcgggatcttgtcagccagaatatcggagacgaggcgctggaacaggcaactcaatgcttgctggaaaagccgtttggagcttggtatgagaaagatttcgggcatatccggggactgacgcggcagactgcaatgcttatgctgcagcactatccggagattcaggcatttatcccggaatttcggacagaggcggatgcggttttcgcggtcagcaacgcttccaagatcacaggcttttcaaactggagtcaggtgtgcggctcaatactggttaccgatcagaattgggcctatctgaaagaaaacatgggattttccgaggagttcgtccgcgagtatcagccggggattgtgaatttcctgctccggggcggcagctcgatggtccgcccgctgtataacgaattgcagtataggaacgaaagtgaaaaaaactgcgaggcgctccggcgtattgtacaggcagagctgatgggccagttctataaactgaaatactttgctggtgatttgaagcaggaaatccattacccaattcaagaggcgcgggaagatgtctggaaacagaatctctctttgaccagactgggccttatggcgaaagaggtggatgatttttaccacacaatccgcatgggcgagcttccgcactttacctgcttatcctgctatcagggcagccagagggactgccttttagccgcattcgatagcaacaaaaaaatcattctggtttacaaagacgagagcgtagtagcacgggcgtgtctccggctgacgaaaggctctttccagcagccatcaacgctcaattttgaatttgctgatctgtccaaagaagatgttcccacaggcagtcacgcatacagtgagaagctggtgctgtttctggaacacatttatacctctggattgaagaaaagtgaagagacggcggcaaaagaaatggtagtggcactggcaacgcagaaagcggaagaactcgacgcggttgcggtgctgtcaaatcagtatcgcggatgctatcccagtgggcggtatgtcagcgccccaatctatatctacatctcaaagtccaaaaatgggcgccagtatcttgactctctgggaggcgctgcagtgactttggcagaggaacagtataagcaagaatcgtttttggtagaacgggccgcactggaccgagcccatgcggcatgacaggaggtttctttatgatgtttgacagtgttttggtaaaagtatcctgcagtgaagaactgctgtatctccacaccatatcccggaggcataaatccccgtaccgctttgcaatcctgcgtgatacgctggagcagttggagcgggagccggggcgtcagatcatcgtggctgactgcggctgctatgccgcccttcggctcacacgggcactggacggcgagatgctggtgatccgtttttcctggctgcaaagcgccggtgcggacagcctgcgcggctatgaggagtgggtgcggctgccctaccgccgcttccacgagtgtgtggaggccgggacggatatggccggatggaactggagccagctctccgtgccggagaaggtgacccgccgctttgaatttcacagcaggcagaatctccatcaaatcgcccagcggccgctcctgcggcacaagctggggaaaactctggaacaccatttccagtggcgggatgcggagaagatcctcatttatgatgacggtgcgccgtacagcttcttctttgaagaggtcacgccccggggcacgggaatctgcggcggcatcattctgcatggtgcggataacctgcagaaagcccagtacagcgtccacacctaattataacagggaggtacataccatgacgattattaaaataaatggcggcttctggggatgggagccaatagagacgctggagcggctttatccgctgtttgagcagtacacattggacccgatctatgagtggtatggaaatttcgtaaatcggaagccggagtggcagcggtcagaagagcgtcaggcgtatcagggctgcacggtaatttcggggcggtttctgcattatgggaactttttctatatcgtcaccgatgaggaagaactgatccagcgttttgagcgcctggtggcggacaacaaggccacacaggcataccaggacgagaggaaagtctgcttcccgtgcagcgagtgcaaccagtggtcggctgccagcgggctctgcggactgactggccgttatagacaaccccagtgggagtgctttgcgcgatatgttctgccgaaggggaaagtcgaaggtgacggcgcaaatatgcgcattgaacttccgatcccggaaaaggcaggaaagaaagcggtgcttatcggccgcggccaatgggaggtttaacaatggattggagcaaagtccacaggaaactcgctggccgcttcaggcttctggagcgccgaaatgaggatggagattgtgtgattcactgtttcggctctttgggccaaacgggagtgaataacgatgatgttcgctatatatgcggcttctatagtcttccctatagagaggactggcgcagagaagaagcccgcgatgccggcgacagtttttatatcctgattaagacggatgactgaaaagtgctttgtctgcccttatcaaaagcatagggcagaatccgtgtaaattcgtaacagggccgggcggaggaaaattcctctacccggcccttctttttggggctgacatggcccgtgtcaaatcaagcgaaatcattttacggtatttcataatcggacggccgtatgctcttttggtctcaattttctattatacttcgacctcatcttcttgtgttttgatatgctgtgtggtactcttttaccatacgcacatcttatttatgcacaaaggaaaggtgatcttaaaatggcagaagccgagaacaagcgtcagcgccgtaccccgcaagagagagcgaatgaactggatgaaaaaatcacgaagataaatcagtccatcaatgagctggaggagaaaaagaaaactgttgtagaagagtacgatgcgaagatcaccgcagcaaaggaacgcatcaaatctctggaggcaaaaaagcaggagatccttgctcccaaggctccccgaaagccccgtaagacgaaaaagcagaaaattcaagagattgtgaagctggcaatgaaaaacggaatgtccgtagaggaaattgctgggcagctccatgtggaagtcgaaaactgaatagttttgatataacaaacagcagcgtcgccttggtagagccgaggcggcgctgttttgttatggactttagtctgttgagcccattggagtttttcgttgttccgaaaaatggagatgggcgaaacaataaaccacccgctatgcgggtgcgcgtcgattgttatacaaaaaatcacctttccgtttacaatagagttgttcaggctgtattgcagaaaggaaaggtaatttatggcgaagaaagaaaattcacttgcgcatatgaaatggatgtgcaaatatcatatcgtcttcacacctaagtatagacgaaaaataatttacaatcaatacaaagcggatataagagatattataaaacaattgtgtagttataaaggtgttgaaattattgagggtcatctaatgccagatcatatccatatgttagtaagtattccgccaaagataagtgtatcatcattcatgggatatttaaaagggaaaagtgcgcttatgatattcgataaacacgcaaatttaaagtataaatttggaaatcgtcatttctgggcagaaggatattatgttagcacaataggattaaatgaggctacaataaaaaaatatatccaagagcaggaaaagcatgatatagcaatggataagctaagtgtaaaggaatatgaagacccttttaagggttaatgccaagtagtaacaataccctttaaggggtagcgacgagtcaagagcaatatggcttgaacggagctgtgggaaggctgtgtaaacagaattcccacagtctaaagagaaagccagcgccttgagacgctggcctagtaacaagggcttatagccctagtgcaaaccacccgttggacgggtggttatgattattttgacgggaaacggtagccacgaccatacaccgtttcaattatgctggcacccagcttgcgacggagtttgtagaccatgctggagatgcctgtccaactggcatcatatgagtccgtagcaacagcctcatagatctgtcgaagggagaatacctgtcctggccggcgggccagcaggagcagaatgtcaaactccatcggcgtcagatccaccgtctggccggcctgccaaaccaacctgcgctgcgggtcaatttgcagagagccaaagagcagcggtgcgtctgtggaggcggccaccgtggagaagtctgcaacagaagcaagaactgatatgatgctgctatagagagtattctcattgtcgctaaaagacagaattataattttccccaataaattacctccatcaattttcattattattcgagaaattatagcgccaatcgacgctattagaggataatgaaaatatcccgccagcctgtagcctgtccataacaggcttatttttttcgatactaattactctctgcgtccagtcacgataaaaggattcttcatgtgatacaagtaataccgttcctacgaaagccataagggctgttttcaaagcctcttttgcctgtacatctaaatggtttgtaggctcgtccataattagaaaattacagggagttagtgtaagcagacacatttttacctttgcctgttctccaccgcttaatgttcctatagcctgcatagcgtgtttactggaaatcccacatcgtgccaaatgtttgcggacatcttttgtcaccatattgggataagcattggcaacaatttgaataggcgtcaattcaggttcttgccactctaaatcctgttcaaaatatccgatagtaacctgatcggaaaatttgaaatggccctgtatagatggaatttccccaatcagggtttttagcagtgtcgattttccaattccattgaatccagtaataacaactttttgtcctcccttaatgctaaattcaatatttgataagacggggtaatggtagccaactgccagatgcttcactaataagtgttctgtgtcggttaaaggaagtacgggaaaatggaagtgcggaataatttctttttggtctaaggcttccattttgtccatccggtcaagctgcttttgccgtccctgcgccatttttgcttttctgcccgctatgttcttccgtataaattcctctgtctttttaatttccttttgctgggccgcatattgccgtacataatcttcccgcagcagggttttcttccgcagaaattcggaatatgtgccgtagtattttgtaatcgtgtcattgtctatatcacaaatgcggttcgctatcttatccagaaaattgaaatcatgggaaaccactaaaaaagcattttccaaagtagataaatattccgccagccatgttacatggtctttgtcaaggaaattggtcggctcgtccagcaatagaacatccggcttttccagcagtaattttgctaaaatcacttttgctcgctgaccgccgctcatttcagcaatcggacggtcaaggccaatcgcaagaagtcctaacccattggcgacacgctcaatagcggtatctatcgaataaaagtcatgggcttcaagctgttcctgataacgggcggccatttcaaggcttttcatatcgccgccagcagctttttcatagagctccattgcctgtgcctccatttcaaataactttgtgaaagcggatttgagaaattctttcatcgttaaggtatggtcgatttccgcatattgatccaaatagccaatcgtagtatttggttgccagacaatgcgcccgctgtctggtatgatctgttccgtgcatattttgattaaagtgctttttccagttccattttggccgacaatgccgatatgctctcctttattgagtgtgaagcctgcatttttgtatagcacattctctccaaaagagtgtgtcagtccgtcaatttctaataagctcatgtttatcaaacctttcctgtatattctctgatacaaaagaaaaaggcagaaagcaaagatacacaaatgtatctgccttctgcctctggcatagcagcgccaaaaacaaaaggctatggacaaaacattgtccatagcctcatacacattataactgcatgggaagccgctttctaaaaatgggtacaaaatcccccttgatggcttcccgatgaaatctaaatgcgtcgtttatacgctatactctgcacaatgtttcatcggtatggattgtacagagttgattttctttttacgctgatcggttaaatgaaagttcatattcatgctgtatctccttttgagaggtgtaatcctatttttcaataatacaatggagaaagtaatttgtcaatctctgtatctgatgagttgtaagcagactatgaaagatctgctatctactcactttttgattttccaagatatagcactatctttggtagaactgagatagtgccactattttttagaaataaaaatatctttaagcgttgaaaaaggcgtcatccaggcgtaaaggatatgtataaagcaaaaaggaggcaataacctatgttaattggtgtcgatcatggcaacaaacaaatcaaaaccgctcatggcgagccctttgtgtctggactgcagcagagcctgacccggccgttcggccagagtctacaatactgcggtacttattacacattgtccaatgagcgtattccgttccataaggacaagacggaggacgaccgcttttttgtccttacattgattgccattgcagaagaaataaccgcccggggcctaagtgagaaagagcagcagcatattcagctggctgttggtctgcccccagcacattttggcgctcaagcggaaaaattcactgcctattttcaaggccgcgggcttgtagcgtttatgtatggggacaaacactataccatcagcatcgaggatgtggcctgctatccccaggcatacgcagctgcggctacaatgctgcatgccctgttggacgatccaaaggcggtcgtattggatattggaggcttcacggcggattatctgttgctgaaaaacggaaaagcagacctcgcctcctgcgattcgctggaaaacggcgttatcctgttatacaataagatcaggtccagaggaaatgcagagttggatttgctgttggatgagggtgatgtggatgccatcctcatgggcagacggacacagtacccggccgaggccgtacagctcgtggagcgactggcgcaggagtttgtcaacgacctgttcagcactctacgagagaggatgctggatttgcgctattgcaaagtggtgtttgtgggcggcggcgccattctgctgcgccggcagatcgaggagtctggcaaggtggggacgcctctgtttgtcacgaacatcaacgccaatgcggccggatttgaatacctgtaccggcttgaaacagtgggcaggtgacgattatggcggccaaaaaagaaaggggacgcttctccctgcgattcaataccagtgacccagtgctgctggccgctgtcgaactgctggagctacagccagcccacagtaaggcccagtatgttgcaaatgcgcttatatactataacgctcatttttctgatgaccctcagccattaaaagcgccagctattgaccgagcagccattgaagcgatagtacgggaaattatgcgtcaggaagagcaggccccagataaggcagtttcgaccggagaatcctcttctccaaaggaaaataaaatagctccgccgccgcagaagcagacggcagagccatcagaaagtttgacaacggctggggcttccgaagttgatgatatgacccgcaatctgattgccagcaccatggcggctttccgtagaaacagctaaaaaaagaggtatgggagcgaagctgtgccgactctcatacctcttacttttcctgtatggcagcaataaagctgtcgataatctgctccaagtggcggtattggctgggtgtcaatgtggaaatcttctgctggagcaacgaagtgtctgcttcaagaattttaccacgcagtaaatagtctgcgctgataccaagtgcttcacagatcttcagcatggtttccgggcgcatcgctttttgccccatttccgcatacgagatggtttgcgatgtgagatgcgtcaaatttgccaaagtctcctgtgtcatatttaattgttttcttcgctccagaatccgctggcccatttctttcaaaagctcattcattcgcaatcctccatactatagttacattttatccactatagcatgaaaaattaagcgaccatggttgagtttaatcaaccatagcatatataatggttgtaagacgaaaaatttggaggaaaaccaggtgaaaatatgttcgtgtgctgtaatcggtcaacaccctacccgcttcaaattcaaatacaatgaatatatgacctcatgcaaacgcataaaaaagcggatgcatgatgtatttgtgtcgctgtaccagcgcggtgtgcgctgctttttcattgggggcgctctgggagtagatatgtgggcaggcgaaatcctgttgaatatgcagcgccagacagaatatcaggagctgcaagtcataatggtctgcccattccccggccatgatgttcgatgggacccaaaaagccaggcgcggcaacgaaaactctgtgaaggctgtaccaaggtgctgatgggtacagaacaccccggaagtgaagggtataaaaagcgcacggaatatatgatgaaacgggccgactatgttgtggctgtttatgataatgatccgaaacattacagtggagtagagacagcgatggggattgctgaaaaaagaaacttgtcaatcgtgttgattcatccagatacaggaattataaacatagtagatcattacagagagaggcacacggattaggaaaaatatgttactgtttagataagaaaaactgaaaagttgcgctgttttggtaatacaaagccaccttgactgtcgaggaaaaatcgggtatcatctgattagtgatagctaacttgagcgagttagaaagaggtggattatgccgcatagtagtttatatcttaccaaactttataacgatttaataactaatacccctcagacaattactatggacattccttctgaagttggacatggcaggatttctcaaacaaaaatcaagcatggtgttgttctctcggactggcagatgtgctatcaatctgatatgaatgtacaggggcctgtcagcagggaatatatgcagatcatattctgcatgaacgatggaatttcctggggtattttgaatgggcatcgctctatgaccattcaaaaaaacgagtcctgcatttatgccggacatgatggtacagaatatatttgttacaaaaaggacagcaacttctcattcaaaagcattaaaattcctactccctacttttcacaactccttgccgattactttgacggacaggaaattgcggcttacgaaaagaaactcctaaatggcattgccaaagtttctgtcacccctgttatggagcaggtcctatcggaaataagcaaattttctcaatatcgcggagggttgggctacctctatttggatggcaagctgttggagctgctgtctatctatctgggggaagttctggaattggatattctgatgggtaaaaatatttccatgtcccggacagagcggaccgccatcatggaggcgaagcggatcatcgacagccagttagcctttgcgccatcctgtgaagaattatcccgtcaagtacatctgagcctcacgaaattaacccgcggttttttagctttttatggcagatcaattcatcaatatgttatcgagcagcgattggtacaagcagcgcagctgcttttggagggggattggaatgtgacggaagttgcctccattgtaggttatggaaaaccgagcaactttgcggcggcctttaagaaaagatatggtgtcgcgcccaaaaattaccgtgaaagctggcttgataatcacaaaaatagaagctgactgtttttgggttgaaatgggttggttttgggttggattagttttatataactgatattctatgtggtgtggttagttgttgctaatcacaccacatttttcactttatcaaggaggcagagcatgaaacaaaagttgaatgcaaaagattttattctaatcggcgtcctgaccgccctcatgtggatcatctgcatgattatcagcaccattatgagtgtggccggcccagtgaccaatgtgttttacccggcggttgttgcgatccccaatggcatcgtgatgatgctcttactggctaaggtaccgaaaaagggcgtgttcaccatctgctccgcaatccaggctatcctgttcctgctggtgggcgctttctggtttatccccatcggcttggtggtcggcggcgtgatctgcgattttctggtcatgggccgaaaggaaatcaccatgaagtccatgactgtggcctacgccctgttcagcgccattttcgccttcagcgccatctgccccatcaagttcctccagagcgcctttgtgggcgccatggagaagaacaacattgcccaggagtacatagacgggatgctgaatatcacctccgtccccatgctggtggtcatcgttgcggccggcttggtaggtggcctgatcggcgccgtgattgggcagaaggctttgaaaaagcactttatcaaagccggactcgtttcagtcaaataacaaggcacagcccctcggcagtcaatcagacaaacgcaggcaagcgggctgcctgatctcagggcgcggggctgaaaatggccccgcgctttgatttggatagggaggcattggaatggaagaatcacaaatcaaacaaatcattgaacagcagccccttcatggatcggcactgttagatccccgctgcaagattttacttttggtctgtatcgggtttgtcagttactttttggccggggaggtggtcagcctcgcgctcatgctggtgtatggcctgtttatcgccgtaggaaacgggggaaagtgggccttgaagatgattgtggcctacatcatcgtcgcctatctcaacgccctgctccgctatgtgcaggtgccggtattgagtgtgattatgagcgtgttcggcgtgacgcttttgaagctgatccccattgtgatgatgggcctttggattttgcggactacctacatggacgacctgatggtggcgctccagcggatgcggcttccccaggcggtgacgatcccgctggtggtcatgttccgctatatccccaccctgcggatcgaataccggcagatccgcagcaccatggacatccgggggatcagcgataccttgtggaaacgggtatcccatcctcttgccaccattgagtatattttaattcccctgctgatgcggtgcctgaaggtcacggacgagctggcggcctccggcactacccgggggctggagctggagtgcaaacggcacgccctgcgccccatccgcttctcctggccggagagcctggtgtccctgctgggcatccttttcctggcggcgctgctggtcctggaccagacccgaatcggggaaatcatcttgtggagggtgtgacatgatctcgtttcaaaatttcagctttcgttatgaggagagcaaggactttaccctccggggcattgatatgacggtgcagaccggcgaatttattctcctgaccgggcggagcggctgtggcaagaccacgctgatccgctccctcaacggtctgatcccacacttttatcccggcgagatacagggcgaccttgtgatggatggacattctctgctggaaatgaagcccgcacagctggccgggcaggtggggacggtatttcaagacccacgctcccagttcttcatgacggacaccacacgggaattggcctttggctgcgaaaatatggggcttccccgtgaggaaaccattgaccgcatcgcaaaagccgcaaaggatctggaactggcggactacctaaaccggagtatctttgccctgtccagcggagagaagcagcagatcgccgtgggctcggtctatgcgctttcaccaaaggtctatatcttcgatgagccctccgcaaatctggactacgcggccaccaagcggcttgcggagatcatgggaaaattgaagcgggacggatacaccatctttgtggtggagcaccgcttttactatctgcgtgatttaatcgaccgggtatttctcatacaaaacgggaaaatcgaacaggaatttacaagggagcagttctgttccttaccggaggaaacgcgcatatcctatgggctgcggactgcatatccggagcgggatgcagagcattatcaggagaaagaacgccgccccatggggaaacacctgctgagtgtgcagggcctttcctttgcttatccgaaagagcaggaggtctttcggaatgtcagctttgaagcccacgctggggatgtaatcggcatcctgggccataatggagcgggcaagaccaccctcttgtccatcctgaccggcctcttgaagcagcggaacggcgagatcacatttgacggcaggaagctcactccacgccagcgccgggcactgtcctatctggtcatgcaggacacggattaccagctctttgccagcagtgtggaggaagaactctccctggggattcgggaggactgcaaagagaaggtggacgccgcgctggaggcgctggagctgtccgaataccaggagcagcacccggcggccctctccggcgggcagaagcagcgggtcaccattggcgcggccatcgtcaaggacagcccggtgatctattttgacgagcccaccagcggcctggactatgactccatggtgcgggtcagccgcctgattgagcagttgtccgcttccggcgtgatcgtgtttgtggtctctcacgactttgagtttatcgtccggacctgtacggaggtggtccagctggacgaccagggggccgttcaaaaccaccggctcacaccggagatattgaaagctctgtcggaacagtattttcattgatgggaggttgaaatcatgtttcaaaaggtatttgaatacgcggggccgcataaaaagggcctctatgcggccacagcggtggtgctggtcagcgttttgatgggcgtcctgccctttgtgctggcctaccaggtaattgctccgctggtgatgggagcggaacttgacgcttcgtttcttatcctgcgggtggctttggtgctggtgtgcctggtcttgcaggctgttctctatggctgggggctcaatctttcgcacaaggccgcctatgacacgctgctccggctacggactgccctgcaaaagcggtttgagaagctgcctctgggcgtgatccaggacaagggcaccggcacggtcaaaaagctgtttgtcgatgatgtggacagtctggaggtcctgctggcccactccatgccggaggggatcgcaaacctgatggtccccatcgcggtctatgtagctatgtttttcgtggactggaagctggcgctgctgtccctggcctccatccccatcagcctgattgccatgatgaccatgtactcggttggcatgaagaaaatggggccctactatatggccggccagaagatgaacaacaccatcattgagtacatcaacggcatggaggtcgtcaaggttttcaacaaggacgcggactcctatgagcggtttcgcaaagatgtttcggattaccgggattacaccttggcttggtacaaggcggcatggccctggatggcaatttacagcagcctccttccctgcactgtgattttgaccctgccgctgggggcgtggtttgtcctctccggctggtcggctctgccggacctgattttggtgctgtgcctctccctgagcatcgggatgccgctcctcaaatccctgggcttcctgcccaccatgccccagctcaactacaagatttctgcgctggagcaggttttggatgcgccggagcttcagcagacgccggacagcttccacggaaaggatgataccatcgtctatgaccatgtttcctttggctacaccaagacacagcccggcccggacggaaagcccatggtggtggaggatgaagtgctccacgacatcagctttacagccaaggccggacagaaaacggccctggtgggagagtccggctcgggcaagagcactctggcaaagctgttgatccactactatgacccgcagaaaggcagcatctccatcggcggacagaaactgtgtgacatgagcctggaggcgctgaacagccgtatttcctatgtggcgcaggatcaatacctgttcaacacctctctgctggagaatatccgcatgggacggttgaacgctaccgatgaggaggtcctggaggcagcgcgcaaggcccagtgcatggagtttctggaaaagctgccccaaggtatccactccatggcgggggatgcgggcaagatgctctccggcggtcagcgccagcgcatatctctggcccgtgccatcctgaaggacgcccctattgtggtgcttgacgaggccaccgcctacgccgaccccgagaacgaggagaagatggaggcggcgattgcggagctggtgaagggcaagactctggttgttatcgcccataagctgcccgcgattatgaacgccgaccaaatctgcgttgtagaccacggcgaactggttgcggcaggaaagcatcagaacctgattcactcctgcccggaatatcaaaagctgtggaaggcggcccaggacagtgccgaatggaacatacataccgcaaaggagggaaactaaatgtttgcactgttttcaaggattttgaaacttgccggtccatataaagggcgtattcagggcgcttttgcctgcgcgtttgtggagtcgatcctgtctaaaatgccgatcttcctggcctttgtggtgttgagcggctttgccgccggaacactgaccgggcagacctgcctctatgtgggccttggcctcgcggcggccgtgctggtgcagatgctggtccactatctcagcgacagcctccagagtgcggcgggctacctgatgtttgccgagaagcgcatggagctgggcggacacctgcggaaactgcccatgggctacttcacctccggcaatatcggcaaaatcagttctgtcctcagcaccgacatggtgtttatcgaagaagtcgccatgagcacgctgggcaacatgatgagctatctgctgtcctccttggttctgctggcgtttatgttctatctgaattggcagttgggcctgatcgcggcccttgtgaccatcttggcgtggctggtttccagagggatgaacaaagtttccctgcgggaagccgctggccgtcaggagcagagcgaacggctgacggacgcggtgctgtcctttgtagagggcatcggggtcatcaagagctataacctgctgggtgagaagtcggaagaactgaccggcaatttcaagcggtccagaaatacatcccttgcctttgagcggaagatgactccgtggactatggggctgaatatcctttatggaatcgggattgccgcgatttttagcctgtcggtctttctggagcggagcggagttctttctctggcctatgtgctgggcgtcctcctgtttgtctttgacctgttcgggccgctcaaggcgctctatggcgaggcgtcccgcctgaccgtgatgaacgccgccctggaccgcattgaggctgtattggaggagccggagctcccggacacagggaaacagcatattccagctcaggcacagcccggccagccggaagtgcggtttcatgatgtggcctttgcctaccaggacaaggaggtgctgcaccacatcagcttctctatgcgcccaaatagcatgaccgctcttgtggggccctccggcggcggaaagtccaccatcgccaatcttctggcccggctgtgggatgtgaaaagcggcagtgttgccatccgtggtgtggatacccggcaagtccccctcgcagagctgatggatcacatcagcatggtattccagcgcgtgtatctcttccaggacacgatctataacaacatcagtatgggcaagccagacgccaccgaggaggaggtctatgaggcggcgaggaaagcccgctgctacgatttcatcatggctctgcctgacggatttcagactgtggtgggagagggcggcgcaaccctctccggcggtgagaaacagcgtatctccatcgcccgctgtattctgaaagacgctcctattgtaattttggacgaggcgaccgccagcgtggacactgacaatgagagctatattcaggaggctatctccgaactggtaaagggtaagaccctgctggtcattgcccaccgtttgaataccatccagaacgccgaccagattttggtcatcagtgacggacagatctcgcagcatggcacccatgaggaattgatggaacaacccggtatttatcaggatttcgtccgtatccgtatgaactctgccggttggagcctgtcttgatggagaggagctccccatgaaacaattacacgcatctggcgaagattatctggaagcaatccttgtcttaaagaggaagaaaggcatggtgcgctccgtagatgtggcccggcaccttgatgtatcgaaacccagcgtgtgtcatgcggtagccaccttgaaagagggcgggtttctcaccatggacgaagactctttcctgcacctgaccgatgtgggcagagaggttgccgaaaaaacttatgagaagcactgctttttcacccgtctgctggtggatgcaggtgtagagccaaagactgccgagcaggatgcctgccgcatggagcacgcaatcagcgatgacagttttcaaaaaattaaatcagggctacaggacaagtaaaagtggtctggcagtcgaggttatcggaggtgatgtagtgggaaaactgttcatattatcagtcgaagaagatgatcttgaaaccgcagagaaaatcatggccttcatagagtcaacagaactggtcatgtgtacggatcttccctctgcccctctgcgctacaaggctttgtgtatcgacgctgcgtgccgtcaagtgttttggcagggcaaattcatagagctgacccctatggagttcgatgtatttcatttgcttgtccggcggcccggacgggtattttcacaaagggagatctatgagtttgttgcccctgattcgtttgacagcagttggacgggaatctccagcatcatttacaagctgcgtcataaactgaacgctgactttatccaaaccgtgtatgggaaaggctatagatttttgccgccgtaacactgttgaccattaaagacaagacaatagaaaggccgaatttcaggtaagtaatactttatacatagagtgaatcgacaagattagagtaacgccagccagcaagcagatataaaaaacgacgctttgggatgaacagtaaatgtcctcaaagcgtcgtttatattttgtctggaatgtgacgaagaacatcttctaccctgcaagaaagaatgttgcaaaggtcgttcagcgttgcagttgagatattccggttttgttttaaagaatccaatgtccccttgctgaaggaataatcctttattaaagaataggtcgtaattccttttcgacgcatggtatcccagagcgggtcgtaagtaataatagagaccacccctttgtgattcctattatatttgacatgttgcatcttgaatattcccggtatttcgggtataatatcttaattacatgatttcatgtccgtcaatttttctcattcaagcgcctgaccatcagcagaacagcttctaaatcttgatcgttcatcgacttgatgccatctataatctcctgaactaaaattggatttcggtattctgcttcctcatcgaaaaacaaacggggcgtgataccgagcgtgtcaatcaaatagagcagttctttcacagatggctgggaataccccgttacaatgttatgaatatagttcttgctatgccctaaatcatagcttaactggtactcggaaactcccttttttacccgtaactctgtaatacggtttctaataaagtccatctccatatacgattcctccaccaccatttcccttatggtacacttttgtggtgtgacattagggtgcacatggtgtgcttttttatgcaatagcactttaatggtgttataattaagtaaaacgccacacgggaaaagagagaaacgcatggatagagaaaaagaatcgcccccggagaggctgccgttctgcttggacgacacagttggtgaaatcgtaagggcatgtcaggagtgccccggcgtctactatatcgcggcccggaaacaggacggcaggtttttggcggacgaatactatgtggtggaacgctcctcgccggccatatcaaaagaggctatgacatacggaagaatgtcggaagaggactcccgtgtgctgctctatccgtttgcggaggaacgacatgggtataaaattattgagtatgagatctatcggtatcaggtccggcacggaatgcacgcagacggacagacctcgcttcgtgatgttgcttttttcaatatggagtatcatccggaatactttgggacctacccggcgccccttgccacgccgcggggccgtactgcacgctacaagccgctgatgaacggcgtcttctggatcgaaacaggcacaggagaggaagtcctcgctgtctgctatcctatttggaactgcgacttctcggaaaccgtattgaagcaatcggagcagtcagaagaggatgtgcgggaaggaattgacaatactttggggtatctgttcttttccaagcgggtcagcagtctcgccttgtttgaactatgggggcagtacgaggagttaaggactggcggcctaatcaactaccccgcattgatgaactatatctgggcctattttccggagtacgccgccacatacaatatgcagaatcagctggggatgcacgataccttcggcctgttgatgagcgcactggggacggaggtggaattgcagaacaacccaaatgaagtaattgcaatgtcaacggccgccgggcttgatttcctgaatttttaattgggctaaaaatgacagatcaggtggaacaatggactgggatcaaaatgaagagctggtagaacaaatccttcgtaccggcatgtacgcaaagctgtatgatgaagaaacaacatacgggtacctgacctatttaacctaccgggtggaggacacgctgttcacttggaaaaagaaaagcgatgtggacgggttttgggccgacctcacatgggaggaatatatctcctttttgcggcgagaaaaaacattgctcctggcagctcaaagggtgctgttcaacactgtgatggctttcccggcctccgcatttgactttacattgtcagaggcagaagtggactttcccgtagcgcgttatgacagcgccgggatgctccatatggcaaagctctattccttcgagaactgtatctcaatcgtagagtttctgatgttccgagcagagagggcgtattatccgctgtggaagaaacagcggggaccccactacacatgggagctttatatcgtggaactgcttcacagccgaaaggaatttgtagacccactatcgagggccttccgcaacgcgctggttcaactggactttctcccggcgtggcagatgatctatccgactattcaagaggatgcagaaatagaataacatgaaaagaccccgcagattcggtctgcggggtctttcgctctcttattctgagctcccctcttgacaaatgaaaaccgtagtgctatattcaaaacagcgttataaaacattgttttgaatgaggaggaatggcagtggcaaaacaaaaggtgggcgtctatgaccgggtgctggagtgcgccaaggaggagtttttgtccaggggatttctggacgcttccttgcgtaccatcgcccaggaagcggagaccagcaccgggtcaatctacacccgctttggggacaaagaggggctgttccgcgccctcgcggagccggtggtggatgaatttaaggccatgttccgcaaggtccaggaggactttcaccaattcccggaggaggagcagagggccgagatgggccagtacactgcccgccatcaggaagacctgttggactacatctacgaccactttgatgtattccgcctgctgctggacggggcccatggtacccggttttcgcgcttcctggacgaactggtggacatcgaggtggagtacacctacaagtacatggaggtcatcggttgcgagagcgtcaaatccggcctggtgacggaggagttcatccatatcatcgtcaccgcctacttcaacggcatgttcgaggtggtgcggcacaacatggaccgcgccgccgcccaccgctatgtcaagatgctcaaccgctaccacatggcaggtttcggcaccgtgtttgaccctcagccctgacaaaagaggctgtgcccttgggtgcagccctcctgtttgcacaaaagttagcacttactaaccaaaaggaggaatttatatcatgaaacaacaaagccccatgctccgtttgtgggagctgggagagggacagcagggcggcctgaagcgggcggtcctgtccgctgtggtgggggtactgtttgggatgctcccttacttcgctgcggcgcagatcatcctgggcctgctgaaaggggagcagagtatgcaatactacctgatatggtgtgttgtggcgctcgtgggcttcctgctccgggccaccctgtattccctggccctgtcccaatcccacaaggccacctttgccatcctgaaatccatccgggagcgggtgctggagaagctgccaaagatgcctctgggtacgattctggacacctccagcggccagatgaagcagatcattgtggaccaggtggagagcatggaacggcccctggcccatcttctgccggagatgaccgccaatgtgctggggccagtgtgcatcctgatctacctgttcgtactggactggcggatggcccttttaagcctggtgtccatcccggtgggcatggctttcatgatggcggtgatggctggctacggcaagcagtatgagggctcggtcaagaccacccaggccatgaacagcgccattgtggagtacatcggcggcattgaggtcatcaaggcgttcaaccagggcaagcagtcctatgcccgcttctccgacagcgtaaaggccaacgcctcctacttctaccactggatgaagagctgccagatgccggtctctctggcccgtgccatctcacctaccaccatgattactattctgccggtgggctggcttctctacaccggagggagtctgcccatcgagacctttatcaccaccatcgtcctgtccctgggcattgccgggcctctgctggccgctatggactttgtggacagccttgccaaagtgggcaccatcgtgggctcggtggacgccatcctgaacggggcggagcaggatcacggggaagcgtcggtggagttccggggccgggacatcaagctctcccatgtgtctttcggctaccacgcggacaaggaggtgctccacgatgtgtccctcaccattcccgccgggagcatgaccgcctttgtggggccctctggctcgggcaagtccaccatcgccaagctgatcgccggcttttgggatgtaacctccggctccatcaccttgggcggacaagacttgaagcgggtcccactgaagcagctctatgaccaggtggcctttgtctcccaggacaactacctctttgacgagagcatccgggaaaatatccgcatgggtcgcccggcggccaccgacgccgaggtggaggccgtggcaaaggccgccgggtgcgacgcctttatccggggcctggaacgcggctacgacactgtggtgggcggaggcggcgcccatctgtccggcggcgaacgccagcgcatcgccatcgcccgggccatgctcaaagacgcgcccattgtggtgctggacgaggcgaccgcctacatagaccccgagaacgaagctgttgttcagcaggccgtgggtaagctggtggcgggaaagaccgttctggtcatcgcccaccgcctcagcaccatcacgggagcggatcagatcgtggtagtcaatggcggccgcatccaagatgcgggcacccacgaagaacttttgaaaaactgcccgctgtatcaagagatgtggcgggctcacatgggcgcaaaggagggagagcaggcatgatcggcgttctgaaaaaaatctggcactttgccggcgaggaacagggcaatatccgaaagtccatgattttaggcttcttttacgcggtgttccacatgttccagatcgcggccatctatgtggtggtgctggccctggtgggcggctccacagaccccgccccggcatggcaggcgctggggcttctgctggccagcattctgggccgggcggtcctcaaccgcttcagccagctccaacagacccacgccggctacttcatggtggcgaataagcgtatctccatcggcgacaaactcaagcgggtccccatgggctatttcaacgaccagagtttgggagagctcaccggcatcaccaccaccgttctggacgaggtggagagcaccggccctatggtactggttggtatcctgggcggcctgatcaattctgccgtcatgctgctgtgcatcctgttctgggactggcggatcggtctgctggccctggcgggaatgctggtgtatctggccctcctctccgggatggagaagcagtccgccaagatcgcccccaagcgtcagcgggacgaggcccggctggtggaggcggtgctggaacagctccagggcatgagcgtcatcaagtcctttaacctgaccggaaagggtgacaagcgggtgcggcaggctctggaggacagccgggcgaacaatctggcggtagagaagctgttcactccctatatctggggccaggagatggttctccacctgttcagcgttctgatcctggccgcgtcggtggggctgtgcctgacaggagccatgtccctcgccaatgcgctgatggcggtcatcgtctccttcctgattttctcccagatccagtccgcgggcagcggcgtgtccgccctgcgtctggtgggcagctccatcgaccatgcaaaccaggtggacgacatcccggagatggatcagcgcggcacggtaatccgtccagaggaccacgagattgtattcgaccatgtgaacttctcctatggaagccgccccatcctcaaggatgtgtctctgaccatcccagatcgaacgaccaccgccattgtaggaccctccggctcgggcaagaccactctctgcaacctgatcgcccggttttgggatgtggacggcggccgtgtgaccatcggcggccgggatgtgcgggagtacacgctggagtccctgatggaacaggtgagcatggtgttccagcgggtgtacctttttgccgacacggtggagaacaacatcaagttcggctgcccggacgccacccatgagcaggtggtggaggctgcaaaaaaggcgtgctgccacgactttatctccgccctgccggatggatataatacggtaattggcgagggaggagccacgctctctggcggagagaagcagcgcatctccatcgcccggtgtctcttgaaggacgcgcccatcgtcatcttcgacgaggccacggccaatgtggaccccgagaatgaggatcagctccaaagggctatggaagccctgacgagggagaagaccgtgctgatgatcgcccaccggctcaagaccgtgcggggtgcggatcagattctggtgctggaccagggcagcgtcgtccaaaagggtacccacgacgaactgatccagcaggcgggcatctaccgggatttcgtgtccgagcgcacggagtccagccgatggacactttgattgatcgaaaaagacaaaactgcagtacagatatttgcactgtgatttttgggtggctatggcatttgcagcaaaaaaatcgccatgcgcagatatggggaacgctataaagaaagcgtgcagttccaaaactaaagtggagctgcacgctttctattctacttctttcctaccttcctaaactctcccggtaacagtccagtgctctttcggaacagctccgcaaagcggctggaggtagaatagcccacagtctgcgcaatctgtccaatggacaaatcagtattggtgagaaggtactccgcttggctcatgcggcgctgctggatgtactcggtgatggtgcagtcatagacttttttgaaactgctcttgagttttgttgtccccatgcaggcaatctgggtcagacgctccatgggaacttccgcggcgtaatggtcgctcaggtaggtagcgactgtctgaatattctcaatatcctgggttgccagccgcccagtggccgccggacgctttttctgatactccaccaccagcgacaacgcttcggctaccttgccctcataaaacagtttggcggcgatcccatctccgcggtaattttgaagctctgtaaggagcctggacatttccgggaagtctgttgtctggtcgatctttcggaatgcctccaccgggttgtggtattcgtccggatactgctttttgagataatcctcatagtaggcgggcatgatctcaacgccgatggagcgaatgggaatatttttgtggatcagcacccggtagggcgaatagccgccgatataggttttgatacacccggcggacagccggcggtacggagccaattcatcgccggagatggaatcatagcgggtgatgctcaaacactctggcagggagaattccagcagagagtcctcgtgaaaggaaaagttatggatcttgatgtcgtacagatccttttgcccgtaggtccagtaggacccctctccgatttcgggcgataacttccacgagatgcctaaagaaccatactgctgattatccgggtcggggataaaaccgtgccctttcaacagcggcgcatagtattgctcaatgatttcgggcatgacaaaagactcgcctcctctttacaacgattggacgaacttttgaaacgaaaagacgaacctcgtttcaaatcattgaaagccgccccaatcgagtgtatgttataggtgacggttagcgaactctaaccaaagagtagcatatcacaaagaaaaagtcaacatgacgcaaaaacaggaggagcaaaatgagcaatcaagtcaattcactgaagaagggccttacggtcaaggaccttgtgacaacgggtattttcagtgccatcttttttgtgtttaccctggtcggcggacttccgttcgccccgaatccagtcctgaccttctatatgccgatgggggcggcgctgctgtgcggccctatttatctgctgatggtggctaaagtgcagaagcggtggagcgtcacaattctcggcatcatcatggggatcatctggtttgccaccggaatgcactgggcattttccctgggctatatcgggatgggacttattgcggacttggtagccggcgccggtcactaccgcaacaaggccatcaatctgctgtcctatatgctgatttccctgggaggcatctatacttatgtggtgttctttcttgacccggacggctgggccagcaccatgctgaaaaatggtacggaacagtcctacatcgacaccatgaacgcctccgcaccctcctggctcctcgtggtcattatcgccggcacattggcggtggcggctttcagcggctgggtcggcggcaagatgctgaaaaagcagtttgaaaaggctgggatcaccgcatgatgggcggagcgtcatcccgacgcgggctgtggctggaccccaggacgaagatattgctgctgttgttctgcatcctttccgctatgatggccccatcccttttctatgaactgggccttgtggtgctgatcgggctgctcggcgtctgcttcgggaagtggaaatatgcctggaagggtgtactgttctatgcgctgattgttctgctcaccctctggattatggacaccatgacgggcacctggcgcaccatgtttatcgcctttttggggctgttccataaggtctatccctgtgggatgctgtccggcattgtcctctctaccacgaaggtcagcgaattcttatccgccatgaaccgcatccacgcaccgaaaaagctggtgatcccgctggccgtcatgctccgctatgtccccaccatccaggaggactggcggtttatcaaggacgccatgcggatgcgggatgtgtcgccgtctcccaagggactgctgacgcacccggccatgacggtggagtgcatttatgtcccgctgatgatggcggcatccaaggcggcggatgaactgtccattgcctccattacccgcgggatcgaaaacccgaagccccggacctgtctggtgcagattcacatagggcccgcagatcttctggcgggcatctgcttcgcggcgtacctcgctgtggggctgtactggaagggggtgttcggatgattgaattaaagcatgtgtcgtttgcctaccaggggcaggagcatgacggcctgcacgacatcaatctgacgattgcggacggagagtgcgtcctgttctgcggccggagcggatgcggcaagaccaccatcacaaggctggtcaacggcctgatcccacaattctatgcgggagaattgacgggcagcgtactggtggatggacaggagatcagcaagctgcccatgtaccagatcgctgctaaagtcggctctgtgttccaaaaccccaggacgcagtttttcaatgtggacacggacagcgaaatcgcctttgggattgaaaacgagacccggccgcccgtggagctggcggaacgggtggagcaggccaccgacgacctgcatatccgcccgctccgaaaccgcaatatctttgaattgtccgggggcgaaaagcagaagatcgccttcgcctcggtctatgccatgaatccggagatttacctgctggatgagccgtcctccaatctggatatgacatctatccaggagttaaaaggccatttgcggctgcttcaaaagcagggcaagaccattctgatcgcggagcaccggctctattatctgatgggtctggcggaccggatcgtgtacttggagcagggccggattgagaagatttttacgccggaagagttccgcggattaccaagggagacccgggaacgcatgggattgcgggcggcggatttagcggaggtgcggcctccgcaagtccacccgccggtatcttcccctgtcctggaacttcgggatgtcacactccggtataaaaagcggacggtcctgcaccgcatcagccttgccgccgcaaagggtgaggtaatcggcgtggtgggccacaacggggccgggaaaacgaccttttcccgcgccctgtgcgggctccacaaggactgcgaggggcagtttctgtgggatggacaggcgatggagcggaagaacaggctgaaacgctcctacatggtgatgcaggatgtgaactacgaattatttgccgagagcgtggaggcggagtgctctttcggcatccgcaatccggacttgaccctggccgcctcaactctggaggaattggggctggctccctatcgggagcgccaccccaacacgctgtccggtgggcagaagcagcgggtggccgtagcggtcagcatgatctgcggaaaagacctgctggtgtttgacgagcctaccagcggtctggactttgacagcatgacccaggtggcggggctgatccggcggctgtctgagctgggaaaggtcattttcattgtcacccatgattttgaatttgtctgccgtacctgctcccgtgtcctgcattttgacgagggcgagatgcccggtgatatacccgttgtgatggacgccctcccgaaactgagagagctgttctctgtcaaggtgaatggctccgaaggagacagagaaggtggcctgggccattcagatggaaaggagaggtagtctatgaaacagaaaaaaaccaatcgtgtggccttgctgctccactgggccggagagcaaaaggtatggctgttcctggccgtgcttctggcgatgaccgggggcctgtgcattgtggtgccctatattgaaatttaccggctgatggacgccgcctttggcgggacctgtaccgaagaactggtggtgcgggtcgtggctgctgtggccgcggcggtggtgctccgctttgtgctgttcggggcgtctggagtggtatcccacaagggagcctacggcgcgctgttcaaggtgcgctgcatggtagcggaacacatggctaaggtgccgctgggggcgctgaacgagcggcggaccggagacatcaaaaccgtactgaatgaggacatcgagaagctggaactgtttctggcccacaacctgccggatctggtgtgctatctggtggggccggtggtggtttttgcctacctgatgaccgtcaatatcccgctggctctgatttccttggtgccgctggtgcttgcggttgtggtgatggcggtcatgttccgcaacacggacgacctgatggaccgggccaaccgttccatcaccgcactgaactcggtcatgatcgagtatatcagcggcatgaaactcatcaaggcatataacatggggagcaaatccttccagaaattctcctccgccattcatgaggaaaacgccatgtggaacgagacctcccgccgcatgggaccaccctacgcggccttcgtggtcatcattgagtgcggaatgctgctcatggtgccgctgggcgggatgtttttcctgaaaggctccctgacggccagcgcgttcctgctgttcatctatgtggggtccatgtacctgacggagatccgtccgctgcaggagctggggaccaatttcgccaatgtgctgaacgcggtcaccaaagcgaaggagatcctggatgtccccatctatgagggcggcacggatttcccccaatgccatgatattgaattgcggaatgtacggttttcctacgatggcaaaaccgatgtgctgcaaggcgtcaatctcaagatcagggacggagagaggctggccctggtggggcagtccggcgccggcaagagcaccataatcgaactgatctcccgcttctatgatgtgcaggagggcgaggtgctgatcggcggaaaaaatgtcaaggagttggactacgacaccatcttgagcaatgtggctatcgtatttcaaaagaccttcctcacccgtgacagtgtactggagaacatcctcatggggagcagcgccagtctggagcaagtgagggccgccgcaaaggaagcccagatcgacgacttcatcatgtctctgccggatggctacgataccaaggtggggagcttcggctcccggttttcaggcggagagaagcagcggatcgccattgcccgcgccattttgaaaaatgccccgatcctgattttagatgaggccaccagcgcctccgacccggaaaaccagatggagattgacagggccatccaaaatctttgtaaaggcaagaccgtcattgtggttgcccaccgcctgagcgccctgaagatgtgtgagcgggtcgcagtggtggaggaccacaccatcacctgtgtcggcacccatgaggaagtccgcagggataacgcttactaccggaaagcctgggaggactacgaaaaggcccggaacatcacctatcagttggaaggggggcgagtagaatgagagaacacgatgtcttgaaaaagaacaaaaatttttacattggcgttgggggaactgttttggagggcctgctctccggcagcctgttcctgttgctttactcggtcatgcagtttttgtgggcggggcagtttgacctgaaccgggtgctgatgctgaccggggcgattgccggcatcttcctgctccgtatcctgatttacagctatggctacaccaaagcccagatcggcggcgcggaagtcagccaaaatatccggctgtttatgggtgatcatctcaagcgtatccccctatcccggtttacccaggggcagaccggcgactacatcaacaccatcaccagcgatgtcaataactatgaaaagatcctgacccacaaaatcggggacctggcgaaaaactttgccttgtccatcatgctgattgtgtttgtcatgacgatctatgtccccgccgggctgattctgctggcggcggatctgctgctgattcccggtttgtggctttctttccgtatggtgaagaagtacggcaaagaaaagaatgacatctgtgcggagaatgtcagcagcatcgtggagtatgtatccggcatccagaccttccgggcttatggcgtgggcggcttgaaaaacaagacggtcatcagcgccatgcgggacttctgccgcatcagctttgtatatgaggccaaggtgctccctgtgggagccgggctgggtatcctgatctggctgtcctgcccgctggtcatcttaatcgcctacgcaccgtgggcagccggggccatcgacacggtttcctatctgttggtctgcatgttgccgctgttctgttccaaacttgccaacgccatttttgtggacctcaccagttacaaaaacctgatgatctccaaagggaagatcttgggcgtgatggatgagccggaggaaagcggcagtatggaggcgctgcggcccgctacccatgagatcatctttgaccatgtggactttgcctatgttcccggagagccggtgctgaagcaggcgtcctttacggtgccggatcagaagctgaccgccattgtgggcgattccggctccggaaaatccaccatcctgaatttgattgcaaaatattatgagccagccagtggcgtcatctccatcggagggaagcccatcaatcatgtggcggcggagcgcgtgctggagcaggtttccatggtagatcaggatgtgttcctctttgacgacaccatccgggacaacatccgtcacgcccgccccggcgcatcagacgcggagattgaggcagcctgccgggaggccaactgtgacggatttatccgcaggatggaaaagggctatgatacccctaccggcgagaacggcaatctgctctccggaggagagcggcagcggctttctatcgctcgggccattctgaaaaacagtcccatcctattgctggacgaggctaccgcatccctggacattgagaacgagctggcggtcaagcaggccatcgccaatctgctcaaggagaaaaagaccgtggtgatgatcgcccataccctttccatcgtcaagaatgcggatcagatcctggtagtggcggacggaacaatcaaggagtccggcacccacgaggaactgctggccgagaacggcaaatatgcggccatgtggaacgcagaacaaaaaatcactgtataaatgagaggttgcgtcgatgaaaaaactccatgcgtcgggcgaggattatctggaggccgtgctggtgctccaaaaggaaaagggcatggtacgctccgtggatgtgtccaggcaccttgatgtatcgaaacccagcgtgtgtcatgcggtagctaccttgaaagagggcggttttctcaccatggacgaagactctttcctgcacctgaccgatgtgggcagagaggttgccgaaaaaacttatgagaagcactgctttttcacccgtctgctggtggatgcaggtgtagagccaaagactgccgagcaggatgcctgccgcatggagcacgcaatcagcgatgacagttttcaaaaaattaaatcagggctaaaggacaaataaaaagtggcctgtcagtcgaggttattgggggtgatatagtgggaaaactgttcatattatcggtcgaagaagatgaccttgaaaccgttgagaaaatcatggccttcatagagtcaacagaactggtcatgtgtacggatctttcctctgcccctctgcgctacaaggctttatgtatcgacgctgcgtgccgtcaagtgttttggcagggcaaattcatagagctgacccctatggagttcgatgtatttcatttgcttgtccggcggcccggacgggtattttcacaaagggagatctatgagtttgttgcccctgattcgtttgacagcagttggacgggaatctccagcatcatttacaagctgcgtcataaactgaacgctgaccttatccagaccgtgtatgggaagggctataaattcttgccgccatgaggattatagaaaagaatgttggtagatagtacgaaaccattcatttattggaactatgcagagtaaggaataaaagtgttataaatctgcggtatgttggtgcataccgcagattttgctatatcataaatagagattggcgagttttattgaagaatacagtagtttatgttaccatagagaggtaagttaagactaacttgatggagtgatgacaatggagaaggtcaacttcaatccggaatggtatggtgtacaggcaaaagtactatcgagaagcgaaagacagctggttgtggattatggatgtaatgggcgtggtatcgtaaaaaattatagcttgtttgagggcatacaactttgcttcctcgattttgaaacggatgaatctatgaggacccagaagttcaatccagatatcctccagattactcactgtcaaaccggacgctatgaatgtgaatttgccaatcatactgtggcatatttgccaacgggctatttcagcgttgcaaccacagcgcatttgccgacttcgttctcttttcccttggggaagtattacggcgttagccttgtcatagatcgtcaggcgctttcggacgaaatacgccggatgatgcggacaattcccattgaccttgataaaatagggacaacacttggtcttgaaacacaatggtatgtcagtgatactccaccgcaattacgacacttgttttccgaattatacacagccattcaaacggagcctgtcggctatttcaaaattaaggccatagagctattataccacatggatcagttgacacagattagcgggtgcgactcaaagtattttgataagaaacagattcaagcaacaaaagctattcgggagtatcttatttcccatctggatgaaaaagttcccttggaacagttggcaaaagaggcgcacttgaatctgtcggtgttccatctggtattttcccacatatatggggacactccgtatgcctacctcaaaaaatacaaaatgaatttagctgcccagtggctttcggaaaacaagatgaaaatcggtgatattgccttggagcttggatatagcaacgcaagtaaatttgctaaagcatttcaatctgtatatggaatgctgccaaaagactaccgaaaaaatcgatagtcatgtacaggcggcgtttaacagcggtagaggtgtagtctctactaattcattggtatctttgggctatttttgcccgtgacgcatagatatggagtagcagccaatttcaaaagttgatagaataaatgtcgcggttagcaagaactaactgcgacattttctcttttaaggagggttcatgctatgtcaaacgcaaagtcgaaacaggcaaaaccaaagacgggtttggcacgatgcatggaattggcttctgacagaaagggccttgtgttcttagccgcggttctttcgtcattggcagccattgcttcgtttatcccgtacatagcggtctattttatgatccgctcaattatcggtgttttcccgaaccttgaccagttggatatggggatggtcatgaattatggctggctggcgctcgccgggatcgtggcaaatatcctactgtattttctggctattttcagctcacacatggcggcatttggaacgctgtacgagttgaaagttctctttgcagaccatattaccaaaatcccactggggtatcacttaacgattggcagcggccgtctgcggaaaatcatggatgaaaacattgaaagtgtggagggctttattgctcaccagtttcctgattttgttgcctctattaccgcccctatcgtcatggtcatcatcctgttggctgttgactggaggtttggccttgcttccctggtcggcatcattcttgcatttgtcgcagagtttattggctttggcagcggtgaaatgaaggagaacatgggcaagtaccaaaaggctttggaagaaatgaataatgcctctgtggagtatgtccggggaatgtcggtagtaaaggcgttcaatcaaacagcatcttcgttcaaaaaactcaaagaggcaatcaccggctatacggaatgggtcctcaagttctctctgggctggcagaattgtatgcctgcctttaccacaatcatcaataatgtttacctgattcttgttcctgtgggcatcctgattgggtccagaacggatgattttgccggatttgcgatgacctttatcttttatctgctctttgtaccagcaatttccggcgtgctgaacaaaatcatgtatatttcagagtcgttcatgcagatcaacgggaatgtggccaggatggacgagatattgaacattccagaaatgccggaaacggctcatcctaagaaacctgctggggacgatgttgttttcaataatgtcagcttttcctacacgggagataattctgagaaagctctggaaaatgtatctttctcggcaaagcagggacagatcacagccattgtcggaccttccggcggcggcaaaagtacgattgccaatctgatttcccgcttttgggatgtgtcctccggcagcattaccatcggcggtatagatgtgcgcgatatggcggaggatgacctgatgcaccatgtcagctttgtgttccaggatattttcctgttcaagcagagcatcttggataatatccgtatgggcaatccttcggccagcgaggaacaagtgattgcggcggcgaaagcagcgcagtgccacgagttcatctccaaactgcccaacgggtatcacacggtggtcggctccaaaggcatccatctctctggcggtgagcgccagcggattgctattgcgcgggctattatcaagaactcgcctatcatcgtgctggatgaggcaacggcgttcagtgacccggagaatgaatacctgatccagaaagcctttgaaaagctgatgcagggtaagacagttatcatcatcgcacaccgcctctccacgatccgcaatgcagataagatcatcgtcatggagaaagggcacttggtcgaagaaggaaaacatgacgagctggtggccgcaagcggacgctatgcacaaatgtggaaccactatacagaagcgattggctggaaaatcagcggaaaggcggtgcaactatgagcagattacaaaaagctctctttttgtcagacaagggttacgcagatctgaaaaaagcaatcttcgcctgcacattgacgaacctggctatgcttctgccgttctgtgtaactgttatggtcttcagtgaaattttgacgccctttgtcagcggtgactccatccagtggaaccatatctggatgctgtggggcgcaggtattgtttcagccatcctggtatttctggccgccaaaaacgattaccgtaaaacctatattgcctcatataaagagtcgaacacgacccggctgcggattgcggagcaccttcggaaactccctatgaatttctttaacaccaaggatctttctgaactgaccacgaatatgatggcggattgcagcagcatggagtccctgctcagcagcacgatccctccactgattgcaaacggcatcacggtgaccctgacctgtatcctgctggccttctttgactggcgtcttgctctgtgcgtattcatcacggttccgattgccttcctcattatctggctcagccggaaccatcaaaagaagctgtttgaaaagcaggttaatgcaaaactggctgcctctgaccaggtacaggaatacctggaaggtatgaagatcatcaagtcctgcgggctgtccggctctcatttcagtgcgttggataaagctctgcttgctatgaaaaagattgccatcaaagtggaaatggctgtcggcgtgtttatgtccagcgccagcatgattttgcaggcaggtattggcattacaatctttgtcggtgctattctcctgaccagtggacaaattgaactgctgcctttgctcatgtttctgctgatggtcacgcggatttatggccctattttggcaatcctggcgaatttgtcctcgctactgaatttgaatgtagttacaagtcgtatgcgtaccttgctcaccactcctgtgatggacggtgacgggaaaatggttccgaactgcgatattgagctttcccatgtgacttttggctacaatcaggaagatgtcatcaaagatgtttcctgcaaaattccccaagggagcgtgaccgccctcgttggcccgtccggttccggtaaaagcacgatttccaaactgattgcccggttttgggatgttcaacagggcaagatcaccgtgggcggcaaagacatcaagagtatggagccggaaagcctcatgtcttatatgtctttcgtgttccaggatgtgaccttgttcaatgatacggttatgaataatatccgtcttggcaatccaaacgcaacagacgatcaggtaattgctgctgccaaagccgcctattgtgatgaatttgtccgggagatgccggatgggtatcagacggttctcggtgaaaacggcagcaccctttccggcggtgagcgccagcgtatttccatcgcccgcgcattactaaaaaatgcgcccatcattctgcttgacgaggccacagcatcccttgacccagagaatgaagtcctggttcaaaaagcgattgccaaactggtagaaggcaagacggttattatgatcgcccaccgtctccgtacagttgtggatgcggatcagatcattgttcttgacaatggacgactggtagaacatggaacgcacgatgagttgatgaagaagaatgggctgtattataagttgttccatattcagcaggaaagccttggttgggcggtataactttgggggaaaagcgttgactggactggctgttctacaatatgataatctgtgtattgacccaaaccagcgtagggcctttgtgagcgggcgagcggtggagttgaccacgatggaattcaatatcctatattatctggccttacaccctggctggacctttacccgggagcagctttaccgatatgcgatgcccgatgactttgcttccggcctcgaaagcgtcaccagccggatctacaagatacggaagaaattaaatatcaatgcgattcaaacggtatatggatatggttatcgctttgaaaagtaagggaacaagcaagaaagcggcctttgtattatagcaagggccgttttcgatttgtgcggataggaaaacatcaataattccaaccaaacggaataaagtcgtctaaacggaatagacaggcagggaggccctcggtaaaatacatcgtgtgagatggacgcatggcgtcctatttttcacgaagaaagttagtgcaatctaaccaaaaaggagagaacattatgtctgaaccagtcaagggccgcgggatgagcggcaaagatgtcattaccgtggggattttctccgccatttactttgtcatcaactttgcctttatgcttctgggcgggctgcacccgctgctttggatcttgatgccgggctttatcgctctgtttaccggcattccatatctcatgatgtgcgccaaggtgcagaaggtgggctccgtcctgctgatgggactcatcacgggcctcatttactatgtcaccgggcaattcaccgttgtgatcctggtatccttcgttctggcctgcggcttggctgaaattacccgtgtcatcacccactaccggagcatggccggcaacctggtatcctttgtgctgttctctgtgggcatggtgggctctccgctcccgatctggctgatgcgggaggacttcctgcggcagatcacagaacaagggatgccagcggactatgtgaacactctggcggccctttcctccaatgggatgctgatcgttctgttcctggctcctgttgttggagcggtcatcggcggcatccttgcccgcgccatgttccgcaagcactttgaaaaggctggcctggtgtaagatggggaacgggaagaaatcgatctttgacccgagagctggactgtggattctgatcgccgccaatatcatcgcgttcagcgaccatactctgtgggtggaactggcgctggtcgctctgctgctggcactgatggttgtccacagaagatttacaatggcagtcaaatgggctgttggatattgcgccctgctggtctttcaacaggtgatcctgccggcgtcgcctatgatcatcgccaccagttttaccatctttgccacctatacccgccggatgttcccctgcctgatgaccggatcgctgatgttgaaatgcactcctttgcgctacctgatcgtagggctgcggcagttacatattccccagaagctgatcgtggctatatccgtgacactgcggtacttccccgctatccgggaggagatcggccacatccgggacgcgatgaagctgcggaatatccgggggttcagccgcttggagtgtacggtgatgcccctcatggtgtccgctacggagacggcggaggagctctccgcggcggccgtgacccgaggaatcgaaaatccagcccgaaagaccagcgccgtgtccttgcgtctaatgccggtggacttgattgggatgctgttggtcctggccttgctgataggctcatttgtggtacaataagggggagtgacaatgataggtttggaacaggtttcctttggctatggagaaaaacaggaaacgctttcccatgtcagcgccactgttgcccgcggagagtgcgtcctgctgtgcggggcctccggctgcggaaagaccacggtgacgaagctgatcaacggcctgatcccggcttttactcccggatgccgtctggaagggcgggtgatggtaaatgggcttgcgccgcgggaaacacccatgtatgaactggcccagcgggtaggctctgtgtttcaaaatccaaagtcccagttttttaatctggacaccgacagcgaactggcctttgggctggaaaatgagggccgtccgccggaagagatccgccgccgcgtggagcaggtcgcggaaacactgcacctccaggaactgcgcgggaaaaacatcttttctctgtccggtgggcaaaagcagcttctggcctttggctctgtttatgccatgggccctgaaatctatgtgctggacgagccgacagccaatctggatcgggaggccattgcccggctccacgaccagatcgccgctttgaagcggcagggctgcacaatcgtggtggcggagcatcgcctgtactttctcaccgatctcatcgaccgggcgttttatcttcggagcggggggctggagcgcgtcttcaccggggagcagtttcgcagcctgccagacccggagcgggaggccctggggctgcgtaccctgaccccggcggtatgcacgctccccgctgtggaatcggccggcagcgaagaagggctgtctgtggagggcttaacctgcagctttcgcaaaggagctcccgtgttccgggatctgtccttttccgcccgccccggcgaggtggtggcaatcaccggacccaacggcgtgggcaagaccacactttcccgctgcctttgcgggctgctgaaagaacaagcgggacaaattctgctgaacggaaagcctctggatcgaaaaggccgccagcggtcggctttctgtgtcatgcaggatgtaaaccatcagctgttctccgacagcgtgtggggagagtgccggatgtctgcgccggaggcatctgacaatcagatttcggaggtgctggacagcctccacctgctgtcctttcgggagcggcatccgatgtccctctccgggggacagaagcagaggctggcagtagctacggccctgctgtcggagaagccggtgctgatttttgacgagcccaccagcggtttggactatgcccgtatggtggaggtgtccggggtgatccgcagtctggcaaggcatgggcggatcgttctggtggttacccatgaccaagaattcatgcagagagcctgtgaccgggtgctgcgattgtaaaaggagaaatttcatgctggagcaagtaatggcagacaacggattccctgtcccgctggtggagggtggaaactgccgggtctttcagtttcacagcggtaccggagaggggatcatgacacaatacgatctgttccccggcgtatccctgatgtacaacgatttccatatggagagctatgattccgcgttccgtacaacggaggatctgctgtgcattgattactgccgccaggggcgcatggagtaccctgccggcccggatgcgtactcctatgtagaggcgggcgacctgaagctggaccggcggctggagcaccagggccattttaccttcccccttgcccattatcacgggatcaccgttggctttgcgctcccccaggccgcccaatcgctgaaggagtggatacgggaatttccggtggatctggcccggctccagaataaattctgctccagtcgccatcccaaggtgctccatggggcgccctccatcgatcacatttttcaggagctctacgcggtgccggagcagatcaagattccttatttccgcatcaaagtactggaattgctcctgtatctggacgcgctggaactgccaaaggatgcggaaaagccttacttctataaatcccaggtggaaaaagtgaaggctatccatcggttattgacgggggagctggaacgccactatacgattgcggaattgtccgaacggttttctgtccctgctacggcgctgaaggagtgcttcaagtcgatttatgggcaacccatcaacacctatatgcgtaatttccgcatggaccaggccgcgcttctgctccagcaggagcctcaaatgggagtggcagagatcgccggccgggtaggttatgacagctccagcaaatttgccgccgcattcagggaagtcaagggcaagacgcccctggagtaccggcgggaaagccaataaatttttccgtccaaacaggaccagaccggcaggacggagcggacagagcggtaagaatcccttataatcgttgtagttagtgtaagcaaactacaacgattttttttgagaggagtattgcacatgaaggaacgaacttggctcggtatcctgctctccttcgccgcaccctgccgggggaagatggccgggtctgtggtactggctattctcagtgtggccgggggcttcgtaccgtatctcggcgtttatcagatcatccggctctttctggagcgtcaggcagactgggagggcattgtattttggtgcggcgtgtgtctggccggctatgccgtcaaggtggcgggatatgccctgtccaccatgctggcccatgtatccgcctacacgattttggagggcctgcgccttcaggtggcggaccggctgatgggggcgccgctgggcgaggtggaaagccggcccattggctccatgaaaagcaccatcgtggaccgtattgaagatgtggagccgcctctggctcacatgatcccggaactcagttccaatcttctgctgcctctggtcgtggtcatcgccatgttcgccatcgactggcggatgggcctcgccctgctggtgaccatcccggtggcgctcatccccatgaccttcgggatgcggacctataacaagaattacgccgcctacatggaggccaacgcccatgtgaacagcgtgatcgtggaatatgtagagggcattcaggtggtgaaggcgttcagccagggggagcgatcctatcagaaattcgcccaggcggtggcctccttccgggacttcaccatgggatggttccgctgcacctgggcctccatgaatctgtgcctgtccattctgccgaccaccctgctggggaccctgccggcgggcgtcgcgctctatcaggcggggatactggacccggcccaagtgacgctctgcctgatgctggccctgggaatcgtgtcccccctgatgagcgccaccgccttcatcaactccatgaaaagtatgcagtttgcagtaaaggacacccgtgaactgctgaatttgccccagctcacgcaggcggagcagaatgtccatctggaaggcagcggcatccagatgcgggatgtatctttttcctatggcgggacagagggcaaggaggtgcttcgccatctgaacctgaccatcccacagggaaaattcaccgccctggtggggccgtcgggcggcggaaagtctaccatcgcccggctgaccgcccggttttgggatgtgacgggaggctccatcaccctgggcggacaggacatccgcaagctcccgctgaagcagctctcccagtccatcagtttcgtcacgcaggacaacttcctctttgactgctccctgaaagagaacatccggctggggcgtccgggggcctcggacgaggaggtgctggcggctgctcaggcggcccagtgcgaagaatttatcggccggctggagcatggctgggatacgacggccggagacgcgggcaagcagctctccggcggggagcgtcagcgcatcgccatcgcccgcgccattttgaaggacgcccccattgtgattttggacgaggcgaccgccttcactgatcccgagaatgaggacaaaatccaacgctccattatggcgctttccagggggaaaacgcttctggtcatcgcccaccggctctccaccatccagaacgcggaccagatcgtggtgctggagaaagggagcgttgcagactgtggcacacaggaagaactgctgggccgctgcccgctgtatcagaccctttggacggcccatgtgggggcacgaaactggagtttcccaaagttaaagatactatacccaaatccacgcttacgttacttccagaacacgctgttgtgcggttactcggaatcgagtgccagttcttggttacctcttgacaaagagagcgtgtcatctatatgaatagcaaccggcaggtgctttcacacacctgccggttgttgatgttttcacgaatcgaattgaatcaggactgttggctcatcaatgatgtccctgtccgctttgatctcaaacccaacttcgatctcactgatgtcagagaccgaggcaatctgattctcctccagcgatgattcctgcagtctgatctctagcgcggcagattctccgtcagcaagctctgcgctgtagaaagagtagtctgtcatgtagccatttacagagagcgaatcgtacgtgtcatcaatcgtgagagttctcccacttgtattctcggcgagcatgagtacatacatatcggagctgtattcggacgagtcttccaatatggtctttgcgacaattcgcaatccgttatttcgatagacctcctcgcctgtggcatcatatcctgtgtccacaccgggaaccatgatttcgatagaacgttcctctgcgatatagttcccgttggggtcaagctgattcagcgacagggcaacagagccgacctcgttgataccatagatgctcaagtcttgagctttgatttagggttataaaatgcactctcgatgcacttttcatccaaataatccacgtatttcgggctgtacataggttccttacgaattttgtagccgttttgtagccagctattttatacgtactaaccgttcgcaacgatttattttgaatgatttgcagcagatttcgatatgattcccgccaataatcacccggaaattgaccgcctgattcacctcaaaaaacatcttggaggtatgaccatgagcaaacttatatcctatcaattcaacatagacacagcctgcgtagaattggtttttgacgatagaagccagatttccattgacttcaccgccgttgaaagcgaagctgctgacaaccgcttccagcagtcagagctggattatctgatctacaatgacccgcttgcttatgccgatctgattctgaacagcaagctgaacgtcctgtttgaataaaccgacatgagcataaacgacagcgtcccggttcataatgattgggacgctgcttattatatcattgtattttgcgaactcattcctcgaacagatacagaagatatccgtagccctctgctttcatctttgcgtaaggcacaaagcggagggacgcgctgttgatgcagtagcgcacgccattgggggactccggatcgccggtgaacaaatgaccaaggtgagaatctccggcacggcttctgacctctgtgcggcgcatgccatggctcaggtcctccagttccactacggcgggctcttcaatgggctttgtgaaagccggccagccgcagccgctctcaaacttatccgtggaggaaaagagcggctcgccggtgacgacatccacatagatgcccttttcaaacttatcccagaactcgcctgtgaaagcgcgctccgtgccgctctcctgcgtaacacggtactgctccgccgtcagcttgtcccggatggattccgccgcgggcttctgatagtcgcccggatcgatgcgcagccgggaaaacagctccatctccgcgcgcgggatgtggcagtagccgttcgggttcttttcgaggtagttctggtggtactcctcggcggggtagtagttcttgagtgggccgatctccacgaagaacttttcactgcgtccccgctcgatctccgcgatgcgctccaccgtttccttcgcgctttcgttggtgtaatagacaccggtctgatactggctgccccggtcgttgccctgccggttctccaccgtggggtcgatcacatagaagtaggccagcagcagggcgtcgagactcacctgtccggggtcatactccacccgcacggcctcccgaaagccggtctcgcccttgcagacggtcttgtaatcggcgtccgcctcgcaggtgccgttggcatagccgctctcggcatcgatgacgccgggaatagactgcatcagctgttccattccccagaagcagccgcccgccagatatatgacattttccgtggtatccatatacatgcttccttcaccggacatatcagagggctgtccggtcatttccttctcgtccattttctgcggcatatttttctgcccggcagtgcagccgctcagcagcagtaccgcggtgagcagaagcggcaatactctccgatacatggtgtatccctcctattacaataaatttggacaggaaagccgggcagccagtccggctttctctccatctcgtgcctaagctacaataaggggagcaactggctgaccaatccctccttgggcttttatgtccgttcgaaagactgtcagccatcctcttgttgtagcgttcgatttgagcaggttgagccaccggatgccggagagttcgtgtcacccaatagattgaatcggcagcgagaaaagatggatttccggttgcagattcttggtattggaggaatgtgaatgaactgcgttggcatcgatgtttccaagggcaagagcacgattgcagtcatgcggccctttggagaggtagtggtttcaccctttgaagtgtgccacaccgtcaatgaactgagcgagctggcaaggcaactcaaaagcttggacggtgagacccgtgtggtgatggaatccacaggtaattgcagtccctggcggcttctctgccggagtatcctatggtgatggagatgtttggtgttggccccactctcggcccacaactcatggctgaaattggagatgtgcgccgttttcattccaagaaagcgctggtggcctttgcgggcattgacgccccgccataccaatccggccaaatagatgtccgcagccgcagcatttccaagaggggatctgcctccctgcgcaggacactctttctggtgatgggcgtcctcctgcaatgcgctccaatggatgagccagtttaccagttcatggacaagaaacgctctgaaggcaaaccctaccgtgtctacatgatggcctccgcaaataagttcctgcgtatctactacgcttctgtgaaagcctacttggattctctggaacatgactgattttcctgcgctataccatctggctggccgccgttttaattttgaaatgcacagcggcttaattttgtgctgcctttttgccgctcccccaaatctgaaatttctacttgacttttgttagcaggtctttctgagaagatgaattcgtttgtcagcccatatcggcagcaagagcctggtcgatgagcttttgcagcgtctccgcctgcttcttttccgtgatggcgcctacgatggggtcacccacgatattgccgctgcggtcgaccacataggtggtgggataggcaaagatgttggtggtaaactttcccgcctcaccgtcggagtcaaaatacacattctgataggtggcgcccttcttggcaagcacatccttcgcctcggaaattgccgcttcgtcgccgtccagagtgaaggtgttgacgccgatgagggagccgcccttcttcgcaagctccttgttcagtgcgtccagctcggaaagctcgcccacgcagggattgcaggtggtgaaccagaaattcaccacggtgacggcgttggcggagaacagctcgtcgctcttcaccgtgttgccatccaggtccttgccctcaaaggtggggaacttctgcatactgccgtcgtcgggagggttgctcgtgtcgctgcccgcgggcatactcatatcgccgtccatggattgctgcacaatctcggggtacttttcctccagcgcggtcagcttgttttcgatattgctgatctccgtggcggcctccttcagccactcatactccttgtcggtgaactgctctttagcggcctcgacggtatccaacaggaagtcgccgtagttttttccgtcctcgatcatggccatgcccttgtcggcctccataaagaccttttcccacagctcggtattttccgacaggagcgcgttctcccgctccagcagctccttgtgcagggcgagagcctcctcggcggttttcggctcgccggtcatggcggagccgttgccgctcatgtcgcccatcttgtcattgttcttcgtgccgcaggccgccagggccagcaccatcagcacggcaaaagccagtgcaaaaattctcttcatgttcattttgattcctccatcgttgttttctttgttgtttctttcccgctgccgaagctgtaacggaagcacactgctttcgtcggacaagcgcggatgcacattccgcagcggatgcactcggtatggttgggcgtttttgtcacgtccacgtccatcttgcaggctctggcgcatttcccgcaggagatgcacttattcttgtccaccttcatctggaagagggacacccggttgaacagcgcgtagaatgcgccaagcgggcagagccacttgcaaaacggccggtagaacagcacactcagcacgatcaccgacagcagaatgctgaatttccatgtaaacagcttgcccagcgccgcccggatgccggcattggcaagggacagcgggatggctccctccagcacaccctgggggcagaggtatttgcagaagaacgggtctcccatgccaacatcgttcacaaggaacgccggcagcaggaaaaccatcaccagcaggacagcgtacttgaggtatgtcaggggcttgagcttctttgtggagagcttctttgtcgggatcttatgcagcagctcctgaaaccacccgaaggggcagagaaagccgcagataaagcgccccagcagcacgcccagcaggatgaggaagcctgtgatataataggaaaagctgaacttggacgagcccaccaccgcctgaaacgccccgatgggacaggctccggaggccgccggacaggagtagcagttcagccccggcacacagacggtcttccccgccccctgatacagtccgcccttgagaaagttcggcagatgcaggttggtcagcagcgtcgcccccgcctgaatccagccccggaagcgggacatggtctgtgaaacgcctgaaaactttttacccaatgcccacacactccagacataatttgattgctttgctcagcactgtcgccgcctcgccccgccagacaccaaagcacagcatggcggctccggccatcagcagcacgatctgcgccgcggcctttttcctgcagctcatttttcatcaccctttccgattttctgcctccatcatagcgcgggagagttaaagtctctgttaagaacgaaaacttaacgcaaaccttatctgtttttgctataatgaaagcaacacaaaaacgaagaaataaaaaggagggctctcatgcaccttttagtaattgaagatgaacgcgccctgtgcgagaccatcgttcgcagcctgcggcggctggcctacagcgtggactactgccatgacggcgaaaaggcgctggcgcttctgggcgtggaacgatacgatctggtgcttcttgatctgaatctgccgaaaaaggacggcatgacggtgctgcgcaccctgcggcagaccgaccgggagacgcgggtgctgatcctctccgcccgcagcgaagtggaggacaaggtgcaggggctggatgccggggccaacgactatctggcgaagcccttccacttggcggagctggaggcccgcatccgcagcctgacattgcggcagttcacccagcaggatgtgctgctaagctgcggcggtctgacctttgacacccgctcccgtaccgccaccgtcaacgggcagacgctgacgctcacccgaaaggaaacgggcattttggaatatctgatggtacatcagggacggccggtgagtcaggaggagctgatggagcacgtctgggacaacagcgtggacagcttcagcaactccattcgcgtccacatctccgccctgcgcaaaaagctccgcgccatgctgggctatgaccccatccgcaaccgcatcggcgagggctatctaatgggaggcgaggaagcatgaagcgtctttctttgcagtggcgcatcacgctgatgaccgtcctgctcatcggcatcacctgcgtggccatgaatttgctactgtgctcctccggtgtgtactatatggacaccattgcggacagcttacagggcggcggcacggtgatcctgaatgaggacggagaggcgagctttgacccgcggctcatagcgcccaacgaggagttgaccatcgtcgtcgatggggtgcaggggcgcttccgcaccaccaactggtatatcacggcggcggtaacgctgctcagcggcatcctcgcctattttgtcagcggacgcgtcctcaagcccctgcgcagctttacctcgcaggtggagcaggtgcagctgaacaatcttgccgatatgaggatcgatgaagatgctatttcggagttccggcagctgagccgctcgttcaaccagatgctggagcggctgaacaacgccttttccgcccagcggcagttcaccggcaacgccgcccacgagctgcgcacgccactggcactaatgcaggcgcagttggagctgttttccgcggagcatcctgatgtgcgaccggagacggcggagttcctcacgcttttgcgtgagcagacggaacggctgatacagatgaccaggacactgctggagatgagcaatctgcggcaggtggcgcggaacgagcggatccagctcgctcccatgatcgaggagatcttcacagatcttgcgccgctctcagataagctcggcgtcacgctgacggcggagggcgacggcattatgaccggcagcgatgcactgatctaccggctgatcttcaacctgacggagaatgctgtcaagtacaaccggccgggcggctcggtacgggtttctgtcactcaggagttggaaaagctcctgctccgcgtctccgacaccggctgcggcatcccggaggtgtatcagcgcagtatcttccagcccttcttccgggtggacaagtctcgcagccgggaatacggtggcgcaggactggggctctcactggtatgggagatcgccgacctccacggcggctccgtttgggtagagaaaagttcggagacgggcactaccattgcggtggggttgccaacgcaacaatcaacgaagccctaaaacccttttattcgtttttcgccgcttcgcttgccgccctgcggcgttcctctctgtatggggcggtcagccggaaagagaagcgtcccttttcaatctcaaattccttgcagcccgtgtccgagtctacgtccgtcagcttgcagacggcagggtgtttgcggttgtatgcggtcagcctgtttttgaggtcggtgttgtgggtgcggatgaagatggtggggtctttctcgtcaaaatagatttcggtggtcttttcctgcttggtaagtcctgttctcataggcttatcctttctgcggctctgtcacgcaataggggtgtttttcaggtgttttcttcggctcttgacttgggaaaaatggcgattttcaaacaggagcgcgccggacgatgtctgccctgtccgacgcgctcccattcgataaaatgcgttttttccggctctacacaggaatcagcgagcttcgtccctcgtgaccgctttttctctgtgcggatggaagaatcgccacagattattacgctgaatcacatcctcatagctgcggactttcccgcgcagctccggactttcccgcgcagctccgtattttcacgctccaattctgccgcacggagctttctgtggacagacttaggtcatagttccttcacaagccaggtctctttaggtaaggctttgttgttgcagttcaacagttcttggatcgccaaattggcaaagcggtgagtcctggatgtgtcccaccccaccaaggcggtaacttccgccgtaccgcgttcaaaatcaaacgaaatttctccccattcgccgtcgttgtccacctgatacaggtagatagcggcggcaattttttgttttctgcgggtctgcgatttccgtttcaatcgaaccatgtggatgacgccagcctctgtcaacagacaggccagatgttccaccgcccggcgataggcacgttccgccccgctggcggtgctgccctcaaactgcaccgccaagtcctcaaagctcatgcgggtgctgagcgggctcacccgaccgcaggtcatgcagacggcgttccgcttttccaaaagggtctgttcccggtaatccagcttttcaaaagcctcccgaacagccttggcccggatgctgttccatagaatgtccgcataattccagctgtcgtcccggcttacatcttctccggtctcctccccctcttcgtcctgtactgtctggtagaagggcacccggctgcggttgcactgtgccaacgccaggtactctgcggcagtcatttcggtgcagttctgatggttggcatattcggcgatgacatcttttgtgctcttgccggaattgttgtagagccaggcgatcccacgagcggccttgtattcgtccagagattggaaggaaccggcctcttcctggcggcggcactccagaagtgcattgccgataaaataatgggcataggtcagaaagtccgcctccttcatcgggtcatagcccggaaggcaatccagcatggcgaggacacaccccattttgtagtccaggaaccgctccgggtcatagcgttccagcccctcccgcatcaggaaacggcgaacacggccattgagccgggtttcatagtggtgcaggaagaaggagaagtagtccaggtttcgctcccgcagggcggcagtgatgtaatcgttgagtgttcctgcctccggcggctgcgggtcaagctgaaagacgcgcgccgcctcccgcatagtcagcccctccggctgggccagaaaaccatatcgggcgcagtagccgtccaacgcccaagtaaattccacttccgccatttcctcaccgccttcctatggcactacaaagccattcgtctctttgcctctgcaagcagggcctcctgggtcatttcctgctcgtatctggtgctggcataactgtggtcagagatcgcccgcagcatcttatcctttgccagctttttcattactttggccagttccgcgtccagcttcccacggcgggtactctggaggatggtattcatccgacggttatagaccgccttaatggggtggtctgccgccagctcccgctgtgcccgcccccgcaggttgccgatctgacggcacgtccggcgccgcttgtcccctggagccagaccgccgcagtatttggtgcgccgggcatcggtggtcaaaaaccaccgcccgcagatggggcactgtctgggcgcatggcccacgcacagaccctcgaacaggtcggagcgaaacatccccacaaaactgacgtagtgcatccgcttcaccagctgcggttccgccgcaccggggcgaatggcggagacgtactgcaccgaggcgttggtcagggtcatccaggagggattgccgtcagagagtgtcggttcttcctggaaaaactgcccaaacagtgctgcatagccctccgccgtgcggtcgtggccgggttcattcagctgccgggcaaacgggagcagggcgtccttgtactggcggagggaatagctcagatgtcccaatacctgggtcatgcggatcagctgcgccgccctgctgtgctggccggtcaaggtgcagagcagctgctcctgctgggaaagctgcaaataatctcttgcatcttccagatacgcggcagagaaaacatccgccagtttcttcccgaagtcactattggacagccgggagaacggccgcgtaacatccatgaaggagaggatgccgctggcagcgccctgcacttggggcagcagcgtcaggtccaccgtccccgtgttcatcccctgcagcaggcggttcatcgtatcgcagggcggggtaagggtttcaatcgcttcagctgaaatgttcaatacctcgcagccaatggtccccgtgggcatggcgcagccctcgtaagtcacggtatcctgccagaaatccagcgacagcactgcgtggttgatgatcttgtccatcggcctcctcctgtcatgtttttctttttctatcatagcacacaggcagggctttgtcatgttttttgaaacggcgctgtcatgccatcagcctgtttttttcgattttccccataactgatacagaggggtgagaaacttgccccacgcatcaagaaatggagggaattgtatgaacctgtttgaaaccgtaaaaaccgccgtcaacgccagggaggctgcacagctgtatggcgttgcggtcaaccgctgtggaatggcgctctgccccttccacaacgaccaccaccccagcctgctggtagcagacgaccactaccactgttttgcctgcggagcgcacggggacgtcatcgacctggctgccaatctttttggcctgagcctgtatgatgcagcccgaaaactggcggcggacttccatcttgcgccggacaagcccccgccggaatccatctgccaaaaactgaaacagaaaaccaaggcacagcagctccaggaggatgagcggctgtgctgtgctgttctgttttggggcagtaccgccggacactggaagagtggaaactgcagtatgctccacagacaccggaggaaacgctgaacgagcggtttgtggaggcttgccaccggcttccctgggcggagtgcctgttggacgccctgctgcaaggagattcccatgagcgggagacgatagttcagcagctgatggcagacggaagcatccaaaagatcaatcggcaactgaaagaatggagaaaggagacaacacacaatgcgcaaaaactctgctgtgccgcccagtcacggcggctggcccgcttggtatgacgggaagaacatcaacgaggtgctgttctgcgaggaatttctggcggcccaccccatgaagtgcatccggggcaggctgttcacggtggatggagcggtggaggacgaggcggtggtcagccagcagatcctggagacggtttccggctgcgtcaccagcggactgtccaaactggtgtccaatctgctcgccagcatcaaactgcaagcctactcgccgccccttcccatcgagaccgaccgcatccatgtggccaacggcacctatttcatggacggccgcttctcgccggaaaagacctactgcaacaaccgcctggccgtgggctatctgccagacgcccccagaccggagcggtggctgcggttcctctccgaactgctggaaccggaggacatccccaccttgcaggagtacctgggctactgcctgctgcccaccactagggcccagaagatgctgctcatcatcggcaggggcggcgagggcaaaagccggattggcctggtgatgcgcgccatcctgggggacagcatgaacaccaccagcatccagaaggtggagaacaaccgcttcagcagggccgacctagagcacaagctgctgatggtggatgacgatatggatttgagcgccctgcccaaaaccaactacatcaagtccatcatcacctccgagtgcaagatggatttggagcgcaaaggcgtccagagctaccagagcttgctctatgtgcgctttctctgcttcggcaacggggcgttgacggcgcttcacgaccagtccgacggcttcttccggcggcagatcgtcctgaccaccagggaccgtccagcagaccgggtagacgatcccttcctggcagagaagctggcagcggagcgggagggcattttcctgtggtgcctggaggggctgcaccgcctcatcgcccagaactaccgctttacgatcagccccaaggcccaggagaacgtggaaacggtgaggcgcggcagcaacaatgtggtggagtttttgcagtcggaggggtacatccgctttcgtgcggactatgaggccagttccaagtccatctataaggcatataaagtctggtgcgaggacaatgtgcgcaagcccctgtcagctaaccggctcagctcggagctgacccagaatgcggcggtctacaacgtggagcccaccaacaatatctactccggcggcaggcgggtgcggggctttgtagggatcgaggtggtcgcacggccctttggctgaaattgaagtgagattttgctgtacgtactgtacggtacgtacagaggattttcgcttttccctcagaataagaaggcaaaatgactatgcaaatttcaaggcctgtgcaaaccgtgaactatttcacggcaggaagcacaggctttcttgtttggtgatttaccgggcagtgaagccccatcgcccggcggtgaggaagcacacggtcgcaaacaaaacaccgccagacggtaaagccggatggggtcacgtttgagtaccccatcgcagcgcaaattacgaatgaaaggcgtccgtgctcaaaaattttatccaccggtgacggcacatcaccgggaaatgaacacatttcacgaacaaatggaggcaaaaacgacatgaaatccaatctgagaaacgagatcaaggcttacattgtgcgctccggctgtacgatgcaggaggtggtagacctgctttctgacgaacatggttggagcgacagtgtttccaacctgtccaacaaactccagagggagtctctgcgctacaccgaggccgtgcagctggccgatgccctggggcacgacatcgtgtggcagcgccgcaccaaaccgtgactctcgtccctatcgcaaacagcgcgctgtttgtgatgggcagtcagcgaaaatcttccgcgttatcgctgacgccaaagagttgcggcccgatgtagggacgcaactcttcgggctggatatggaaaagcggtggggcagattttctatatccagcggcgggcatcgcaatgcccgcaatccccctcggagagcccacggcactttgcagcccttcgggatgaaagtgttatagtgggttattacacttcccgcaggaagtgcatcccccgtcccgcagccgtccacgccccaacgaaaggagttgatttttatggccagaaacgatggaatcgaccgcaccagcgccagaaatgtggatgtcccggacaaggacatcggcaacacccaaaagcacaacgaacgggaaaaagacagctaccgcaaccccgatattgtcccggaacgcaccccgctgaatatccacttcaaagcccccaccgccagctacacggagatgttccgacagatggagcaggacaaaatcatctccacacgtggtctgaaacccgacgccatccactttggagagctgatcttcgatgtgaactccgcctacttccacaaccacggcggctatgaatttgccaggcagttttacgccgacgcctacaaagccgccgtggagatcgtgggcggggagcagtatatcctctccgccgtgatgcacgccgacgagatcaaccgggctatgtccgaggcactgggccaggaagtgtatcactaccacctccatgtggtctatgtgccggtggtggaaaagcagatcctttggagcaaacgctgcaaggacaagtctttggtcggcacggtgaaggagaccgtcatgcaggtcagccggagcaagaaatggatgtccaagcccgccctcgacgccgatggaaacccggtcttgcagaaaaatggaaaacccgtcttgaaaaagtcctacagtgtgctgcaagatgattttttccattttatgcgcgccgccgggtataccgatgtggagcgcggcgagcgaggcagcaccgaagagcatctgaccgtgacccagttcaaggtacaggcggagcagcagcggctggaggctgtgaccgcccaggtggcccaggcagagcagacgctgaacgccaccgaggccgtcgcgcagaaaaaagcaaaggagctgaaatccctccaaagccagaccaaagaacagcgcacaatcgccctgactgtagaggaaattcagtcaatgggcaagaaaaatcccatcacgggaaacatttcactgacgccgcaggagtgcgacacattaaaatcctacgctgtcaatagtatcatcgccaaggcggacaacggcaggttgcaggagcggctggcttccgcccaaaaaagcgccgcgatttggaaaaagcggtatgaatcgctgagcgaaaaatatcaggaactaaaaaagagcgtccagccctatctggacgccgtgaagctcgcaccggagagggtgcgggcttttcttgtggccgttttgacccacacctcgcaagcaagacagcatgagcagcccgcgcgccgccgcgggcaggatatggaactttgatcaatggaggtcactatatgaaaaaccaaaacgattttatcaacgaaatggacgatggatatatcgacatcgaatcctgctttgacccggttttcgagccgccggcagaactcctggaagaatggagcaggcggtatgaggggccagaaccgaccttggaaaacacatcgttttatgtcgttggcccggacggcacgaagtatttctactgcgggaatctctgcatcaaaatctccgagcattttgcggatggaggcaagcagatggacgagctggtggaggacgccgtccgccaccatgcgggccgggacagcagcgccccgacctttttgaatgccgtttaagcgtacaaagagcaatgattgatcgttgaatcgcgcccgcgcttacagtataatagatgtagaagtattgtaagcgtgggttgtttcaacgcaaaggaggatattacagtgaaacaaccaaacaatacgaaaaccaaaatctacagcaccgctttgtatatgcgcctgagccgcgatgatgaaaatttcggcgacagcgtcagcattgagacccagcgcaccatcctgcaaaagtttgccgccgagaacggtctgcgcgtctatggtgaatacgtggacgatggatggagcggcaccaattttgaccgccccagctttcagcggatgatgaatgatgtggaagctgggaaagtcaactgcattgttaccaaagacctcagccgttttgggcgtgaacacgtgatgatggattattatctggagttcgtgttcccggagaaacagatccgctatatcgccattgctgagaacgaggacaccgaaaagggcttgtctgagtttgtgccgttcaagaatctgttcaacgagtggtttgccaaggacaccagccgcaaggtaaagagcgcgctccacgcgaaatttgaaaagggagaacgtatctttgcctatgcgccactgggatacaagcgccacccggagatcaagaacacgctgacaccggacgaagaaacccgctggatcgtagagaaaatcttcgatttggccgttcatggcgctggcgcggccaagatcacccgcattttgattgcggaaaaagtgcccaccgccggttggctgaactacaagcggtacggaacctttgccaacatttacgccggcgcgccggaggaaaagtcctacgcctggacgattgcacaggtcaaaagtatcctgaaagatgaaacctatatcggcaacagcatccacaataagcagaccaacatctcttacaagaacaagaaaaaggtccgcaagccgaaagaggaatggattcgtgtggaaaatacccatgaagcccttgtcagcaaggatgtctttgaccgggtgcaggagctgatcgagacgcgccgccgcaagcagaaagacggcacgacacagatcttctccgggctggtgaagtgcgcagactgcggctggtcgctggcgtttggcatgaacaatcagaacaaaaagccctatggtcactaccattgcagcaactatggccagggtaccggacactgcaccatgcactatatccgctatgatatcctttatacctacgtcctggcacggattcaatattggtcttaccaggcacagatggacgagggacgcctgctgcaaaagctgctgaaagccggtgacagggagcgcacggcaagccagaaaaaacaggcagcggagctgaacaaggcagagaagcgcaaggccgagctggaccgcctgtttgccaagatgtacgaagattgggccgctgggcgcatcaccgagtacaacttcaatatgctgtcccagcggtatcagaccgagcagcaggagctggcggaaaagatcgaaaagctgaacgccgaccttgtcgcccaacagcagagcgccgtggacgccgaaaaatgggtgaacctgatcaagcagtatgtgaatccctcagaactgactgccgaactgctgaatgccttgatcgagaagattgtcgtccatgaagccgtaaaagacgaaagcaacacccgcacccaggagattgaaatctactaccgttttatcggcaaagtggagtaaaaacgcaaataaaccatttatctctttaagttggggaaaccgggcggtcacatccggcaaaaaggaggggaattgagatgtttcacagcgtaggacgcattatgggatgggcaaagaactatcgaaagcgaatgattctgggctttgtgtgctcgttttttgcaacatggtgtaccgcggggccggtgatgctggcggcctgggccctggggcggatgatcgggaacgcctggggagagaatgagctttccggctctctcccatggctgtgcttatctggcatcgtcgttctgatcctgctgcggtttttcttcacctattggaaaaaccggctccaggagagcatcggaacggaacgggcggcagagcagcggatggaactgggagatgtgctgaaacgggtgtcccttgggtactttgccaaaaacaatctgggggacattttggcggcgctcaccacggagttgagtacactggaactccagagtatgaaaatggtggacgcggtggtaaacggttatattcaggtagccgtgatcctgctgtgcgtggcgattttctgcccgcccgccgcgctggtggcgctgatcggtgtgctggtgtccgcctttgcgctgcggggcattggccgtcagagcgcccgcaccgctcctgtgagccaccgggctcaggaggcattgtccggcgcggctgtcgaatacatccacggtctgccggtagtgaaatcctttggacaggacggggtttccgttcagcggttccgggacgcctgccgggacaataaggccatccgaatcaaaaacgaatttggtttcgtcccctggaactgcctgcatctgttcgctctgcgggcggcgtccgtggggctggtgctcgccgcgggccagcaggctttggcaggcgctttaccgctcccgtatttcctgatgatcgccctgttctccttcaccattttcggcagtgtggaggccatcaatgacgcggcccacatcctgtcggtgacagattcggtgctggaccggctggaggaactggaacatacggatttcattgacaagggcgggaaagaggtcacgccggagcggttcgatgtgtccctctcccatgtatccttcgggtatgggagccgcgaggtactccacgatgtgacctttaccgcgccccaggggaccactaccgccattgtggggccgtctggctccggcaagagcacgatatgcaatctggtggcccgcttctatgacgcggaccgcggctccgtgtcagtgggcggccacgatgtgaaagaatttacctgcgaaagcctgctgaaaaacatctccatggtctttcaaaatgtgtatctcttccaggacagtgtagagaacaatatcaaattcggctgccccgatgccacccacgagcaggtggtggccgccgccaaagctgcctgctgccatgacttcatctcggccctgccgaacggctatggcaccgtgattggagagggcggctccaccctttccggcggggagaagcagcgcatctccatcgcccgggccattttgaaggacgcccctatcgtcatccttgatgaagcgaccgccagtgtagacccggagaatgaacacctgatccaacaggctctgtccgctttgacaaaggggaaaaccatcctcaccatcgcccaccggctggctaccatccagcacgcggatcagattctggtggtggaggatggccgtatcgcccagcggggtacccatgcggaactgatggcccagggcggcttgtaccggcggtttattgagattcgggaacaggccgagggctggagattggcgtgaagaaaagagtgaaacggcaacacggcacatcacttcatgcctctggcgaagactatctggaggccgtgctggtactccaaaaggaaaagggcatggtacgctccgtggatgtggcccggcacatgggagtctccaagcccagcgtgtgtcacgcggtagctaccctaaaagaagggggcttcctcaccatggacggggacttcttcctccgcctgaccgatgtgggcagggaggtagccgaacagacctatgaaaaacactgcttctttacccgcttgttgacggaggcaggtgtcgatccaaagacagcagaacaggacgcctgccgcatggagcatatgatcagcgagaacagttttcggcatctgaagcagagtatggacaaaaagaaatagccgcaggaggtgaggctggtgacagggatggccgtgctgcaatacgggaatttgcgtattgacccaaatgaacgcagggtctatgtaaatgaacaagttgtggaattgaccacgatggagttcaatattctatattatctggctttacaccccggctggacttttacccgggagcagctttaccgatatgcaatgtctgacgactttgcttccggcctcgaaagcgtcaccagccggatctacaagatacggaaaaaactaaatatcaatgggattcaaacggtacacggatacggttatcgctttgagaagtaagagacactggtgattgtaatagcatatacttaataaaaacgcagctgccaaccaaggcagctgcgttttttgtttaatgaatagaatacaccgacccgcatacggttcagccgttataattgtggcttgacaaatacaatcgtttgatttaagataatatcattattggataatatgattatcgaaaagaggtgaacgaaatgcgtcctgtaaacgaaaagctgcggaaggatctgctggaagccgggaagcgcgagtttatggagaacggcttccggggggcatccttaaaaagtatagcagcctctcttggagtaacaactggagcgatttaccgctactatacggacaaggaggcactgtttgacggattggtgagagagccagcccaagagctggtagagcgttatcggacccttcagcagacctttgccggcaggagtttggaggagcagcttcaaaagctcccggaggtaccggacaaggaagcctcctggatgatggactttctctacgaccactttgacgcattcaagctcatcgcctgctgttcctccgggacaaagtacgagcattacctggataccctggcggaaattgaggatcactctggacggcttctggtggatcgaatggtggaagctggctatcccattcgccgtctggatgatgagctgatccacatcatgtccaccgcacttttcaacggcatgtttgaaacaatccgccatgatatgccgcgggaaaaagcgatggtttatatggatgacctgcggaatttttactccgcgggctggttccgtctccttggaataccctttgaataaagggttttccttttgattttaagttagcagttactaaccataagaaaggggttttaagctatggataacaagaaagcgccctcaccctttgctgtgctgtggggttgggcaagtggtgagcacggcggattttatgcttcggtagccctggcggtgctgggggtggcctgcggtatggcgccatacttctgcgtggctgctatgattgggctgctgctggaaggaggcggccttgtggagtgcctgccctggtgcggtctggccctggcaggctatgcgggaaaggcgctgttttccacatggtctaccagcctgtcccacacggccacctatcacacgctgcggcgtgtgcggcaaaatctgctctccaaactgagccgggtgcccatggggacgatcctggacacgccctccggccagtacaagaccaccattgttgaccgggtggaagggatggagcccactctggcccatctgctgccggagatgacctccaatttgctggtgccagtgagcatcgcggtctatatcttcgtcctggattggcgaatggggctcgcctccctggtgaccacggtgattgggttcgcagtagcctcccagagtggcaagacttacgctgcccgatggcagggcgccgtggaggtgggccgccgtatggcaaatgccatcgtggagtatgtgggcggcatccaggtggtcaaagcgttcagccagtccgccgggtcttataagcggtactccgatgccgtgaccgagaacgcccaatactatgtggactggatggcggacaatcagaagtatatggcggtcatgcaggcggtcatcccctcggtgctgctgcccgtcctgccggtgggactgctgatgtggggcagcggaagcctgagcaccgccgtattcctcaccatcgtcgtgctgtccctggggcttaccggtcctctggtatcagccatgacctttgtggacgaattggcggtggtgggtaccaatgtgggtgagatttccgccattctggaggctccggagctggagcgccccgcggcagagacgaagctgaatgggctgggtatccggctggatcatgtgtcctttgcctacaagcaggaggacggtgaagtgctccacgatgtaagtctggacatccggccggggacggtcaccgctctggtgggcccttccggctccggcaagagcaccatcgccaagctcatcgccggtttctgggatgtgacgggcggctctgtcgccttgggcggtgtggatctgcggaagatcccgctggagcagctcaaccgccagattgcctatgtatctcaggacaactacctctttgaccgcacggtgcaggacaacatccgcatgggccgcctgaacgccaccgatgcggaagtcgaggcggtagccaaggttgccgggtgcgatgatttcatccgccaactggatcagggctacgacaccatttgcggcgggggcggcggccacctttccggcggcgaaaagcagcgcatttccattgcccgcgccatgctgaaggatgcccctatcgtcattctcgacgaggccaccgccagcatcgacccggagaatgaggcggtcattcagcaggctatctcccggctgacggagggcaagacgctgatcgtcattgcccaccggctgggcacggtggccggcgcggacaacattgttgtggtggaagatggccggatcgccgcccaggggaagcaggaggagctgctggcctcctgcccgctgtaccggcaaatgtggcagtcctatctgggcgtccgggacggagaggaggaataagagatgttcagtgtacttcggaaaatttccgcctttgcgggcagccgcagggggcttttgaaaaaatccatgctcgtggctttcctgggggctgtgttcaccgccttccagttctgggccctgatgctgaccctggagatcctggtggccggcgcgaacttgagcatatggccggtgatcggcgtcatgctggtctctgtggcgggacggaccgcctgctcctactggtccaccaatgcggagacagagacgggctacttcatggtggcggaaaaacgggtccatatcggagaccggctgcgctacatccccatgggctacttcaatgacaactccttgggcaacattaccgccgtagtcaccaccacactgggagatgtggagaataacgccgcccgatgcctggtcagcgtcatcggcgggttcctcaacactctggccatgagtctggcaatcctgcttgtagattggcggctcggcctgctggctatcggggggattcttgcctatctgctggttgcggaactgagccagcggtctctgctcaagacagggcctgcccgccagcacgcccagatgaagctggtggaggcagtgctggagtacatccagggcatgagtgtggtaaaggcttacggcctggataaggacagcggccaggctgtgcagaaaaccgtggatgaaagctgtgaaaaggccctggggctggaacactccgtagccccctggatgggcctgcggcagattacggtgcgggtgttcgccgtggcgctggctgtgtgcgccctggtgctctattccagcgggagcctgcctctgacccggtgcctgctgatgcttgttgcctctttcatgctttacgcggagctggagagcgccggcaatatggcagacaatctccagatgctgggcgcctctatggataaggccaattccatcgacgatacgccggtgatggacattgacggggcggagctccgcccggaggatgcctctgtccggtttgaggatgtctctttttcctatggggaacggaccattctggatcatgtgagccttacagtccccgccggcagcaccaccgccgtggtaggtccctccggcggcggcaagaccactctgtgcaatcttatcgcccgcttctgggatgtccagggcggaaggatcaccgtgggcggccatgatgtgcgggagtacaagctggacagcctgatgaagaacatctccatggtgttccagtcggtgtatcttttcaacgataccgtggagaacaacatcaagttcggccgcccggacgccacccatgagcaggtggtggccgcggccaaggccgcctgctgccacgattttatcatggccctgccggatggctacgacacggtattgggagagggcggcggttctctctccgggggtgagaagcagcgtatctccatcgcccgggccatgctcaaggatgcgcccatcgtaattctggacgaggccacggccagcgtagacccggagaacgaagcggaactccaggccgcgatctcctctctgacaaaggggaaaaccctgatcctgatcgcccaccggctgaaaacggtgcgcaatgccgaccagatcctggtcctcaatggcgggcacattgtccagcggggaactcatgaggaactgatcgcccaaccgggcctgtatgccgactttgttcatgtccgggccaaggccaacagttggaagctggaggcttgatgcggcggcttatctgcctgccggactccgttgtatcatgggctggggagggacttctatggaattgaattttgaggggatcgcagtcggagcggcctctctgctggtgattggagcctttcatccgctggtaatctggtgtgaataccacttttctcaaaagatttggccgctgtttctcctgtgcgggctgatctgcctgggtttggcgctgtttgcacatgggctgctctctattcttttgggacttgtgggcgtggcttttctttggagcatccgggaactgaaagaacaggcacggcgggtagagcggggatggtttcccaaaaatcccaagcgaacttaacacaggagcgccgaggagttccagactacggatgacagtgccagggttcaggagattttcgatgaactgctgaacttcgacaacgacaatgtattggatctgcccctgctgtttgtcaaggatatgatcgtctacaacactgacaaaatcgcaggctatgatttttccagcacgcccatgttctttgatgtgcggctgatccagccggcggagtgatggactagcagaatatgagacaaggagccggcctgctaagaccggctccttgtcaaaggatgtgtttccaaaggaaagggggcagatttgtttgtcgttgcaccagtccggcgaggactacttggaagctatattgatgctccagaaagagaaaggcatggtgcgctccgtggatgtggcccggcacatgggggtgtctaaacccagtgtatgccacgcagtagcaaccttaaaaaagggcggtttcctcaccatagacgaggacttctttctccgcctgactgatgtgggccgtgaggtagccgagcagacctatgagaaacactgcttctttacccgcttgttgacggaggcgggtgtcgatccaaaaacagcggaacaggaggcctgctgcatggagcatgtgattagcgagaatagctttcggcatctaaagcaaagtatggacaaaaagaaatagtcgcgggaggtgaagctgttgacgggggtagctgtactgcaatatgggaatttgcgtattgatccaaaccaacgcagggtctatgtaaatgaacaagttgtggagttaactacaatggagttcaatattttatattatctggccttacaccccggctggacttttacccgggagcagctttaccagtatgcaatgcccaatgattttgcctctggccttgaaagcgttaccagccggatctacaagatacggaaaaaactaaatatcaatgcgattcaaacggtacacggatacggttatcgctttgagaagtagaagtaaaagggagcggcctttgttgatcaatgaaggttgctcccttttgccgtgttgaaaattggaattaaaatggaaaaagtgaaaactcagtcagaatttggtcagatttaccgaatacaatggagataaattctaaccatataggcaactttcgaaaacgggaggaatgtgtatgaaaactaaaaatcgaaatagcagagggaatttcaagttgcgttaggcggtcttattcttaaatgaatgaggccgccttttcttttaattcccgacaaaattctacaaaaaaatcaaattactgaacctggatcattggcagacctgctgcccgctctaatgggcaatgcaggttcgtgtgcaaagtgcggttcagatggcaaggagccaaatgcgcatggaaagtttgaaaaccatgcacataaaaaggttcgtcgcccatctgcttacatttcgacacacagtttactatcgaatatggttcttctgccgcccttttcggaggacagggcgggaacatcacaagacaagcgacaagcctcctcctgcgggcgtcggaagtcgtgacggacttctttatgtgtatcacacagccgattgctcacctttgtggtgtgtggtcggctgcgttgttttatatagaacacgaagacgcccattagttcggtgccgatcccctccaaatgttcaagattcccaaaaattcttgaacgatttggaggacaagaccatgcggtatcgaaataatggacaaatagaggaagaactgcaaatcagatttacaggttacttaatccaggcagtaaaacgcacacggcgcgattacctgaacacactcaaccaatacagcaacagtgaaatactgaccgatacaacctataccacaggacagactttggaacaagaggttacagagcaccttcctctatgggatgtgatcgaaagtaatgcgctcttctatgcactcaagcggttgaatgaacgcgagcggtatgtgttcctgtcgcatgttttggacaactgcccttttgacttgattggtgtaagactgggcctgacttataaaggcgcagccgcagtctattaccgtgctgttcaaaagttgagaaaaagtattgagggggtggaaaaacatgatatttgaacaactgttgtttcaggcaaaagaaggtgatctggagtcaattaccgatattttgaatatgtatcggcccttactgctcaaatattctgtaattgacggccggctggatgaggatctataccaggagcagtgcattacattgatgcgagccatcaaactgttccgaatttgaatttatgagaaaggctccgagaccttttgatctcggggcctttcccgtggattcaaacaggatgtactaagaggaaaaaaacaagcgcacagcagtagttggatgctgctgtgcgcttatttcgatataacctatggaccccaactttgcggttggggccacactgcggtaaaacctaccctactacgattttttattgctgcgaaaaggagctctgaccatacctattgtaatttcattgctcttctccagcggcagccttatcatagtagtagatataggcgttgtaatcccgaaaccgagtgatcagccgaatccggatgtacaaatgtgccgtttcagaatagaggttaaattcagtcggatcactggtagtctcggcatatcggcagaagcgtttcatggtctccagcgtcttaaaggccggcaacttgaatagggcattttgaaactcatcgatttcttttaccaactctggcggcgtctttttgccgctctcattgtgccaggttgtccaccagcggtatccatcgtaatccgaacgggaataagcaagttcgctgacggggcgttcgatgagctgcattggaggcttgtaggtgtgcttgaacacttctgaaaaagtgcagttctgcaccagataacagatggacttttccgcttttttcttcaggtgtccagacttgacggcatcccattccacgaggagcaggggcgtatgggcggcatcccgaagggcctcatccatgccgcaggcttcacagatctgcacatccgcgtatcgactgagggcgttgaccatcaggtgggctgccagaggagcgccacaccgcaggcatttgggaggggccgctgcatcgccatgagcataaagctttttgtcttgcttccaagcggcttccagtaattctttggggtataatttgattttcataattttttactccttcttccggtttttcttttcattgccttttgacgaatattggtagtttcttgaaatgtttgagcaagggatggatcatgtcttgtgtcgcttttccagtgccgctcctttgaccagggctggtagactggaagctcttcctggaacaatgccagcaattcagcagccatgtcctcacggcggagatataggctgttcttcacagtctgggtatcgcagtcggtgatgatggtacgcagcgagattccgtgatgctcaaaggtgaaatgccggtgatgagctgggtcttccgcctcaatccatagtggaagcgtatcagaggaaccctctaaacggcgccagccgctgtaatcggtgtaatgaaatcctggtatgtgttttgccagccggcgcagggcgatatacaaccgcatataccgtctgccaagctcgccgttcaaccggcgggaatagtaggtgtacccgtccagatccagttttttcagtttttgagtgttgaagatgtattccacatattctgttccgtcttccagccgtacttgcccggtgcgctcgcctaaaccgttgcgcttgatccaggcatgataccgcttgccggtggttttggtgttgataaagccgcaatctttggcgcgtaagccgcccagattgacggtcagactgtcccagaagaccagctggccgaagctctcttgatagagtttgatggcaagattaccttctggataggtggcgattttaacagttagtgcatattcggttcctttcattttaaatggtattggtttcataatctctccgtgaactagaccaggggactgcaaggacagccccctggtcatggttataaaactgtgcgcctgtccccgcagtatgagagcggggaagaggtgatgcctttgacggccctattggaatcttaaagatttcgggtcattcgtacattaggcggcacccgccgcgctttcaaagagcttgtacagtgtggcacacatatccgcttgatttctacaggaaatggtatgagcatggccgtgatttcgcctctcatgatccattggtcctaccgtgatgctcaactgagaacgctcctgagtaatccagagtcgtctgccagcggacgggtcttcggctacaatccaaagtggacgctggcgatccatataggaacgatagtaggaacgccacccgctataatcggaatagcggaagtcgggactgctagaacggcgctgttccagaacttcatagatttttttgtatttcatgcgctgcgcctcccttcctgcaatgatagatattcagcgtacccctccgggtccagttcacgcaggcggtctgcccggaagcggtactctggatactcacagtaaccactgcgctgcgttgccccggtagggatagccaatccgtggcggatcagccagaccgggaaatcggcgtcaccattggtatcgatgaacgcgcagtctttcccccgttccccgtccagattgaccgtcagagaggcccagggctccgcatagccattttcccatgtgtgcatggcaatcgccaggttgccgtccatataggcggatacctttagctggatgggatgtgtggagccgtacttttcataagggaaggtaataggcccttgcctacccatggccggcattggcctttgggccggagctgtactgatgtttggtgtcagatccagttcccagcatatagcgagaatatcagaatcgtccacacggtagttatattttttggcatacttggggtggaagagaagctgaccattctccacaacaaatttgccttccttggtgccataggtgtactggcggccatccagaagatgttgcacctttttggcgtccgctttgatctttcctttgtcgtaccatgtggtgtactgcaccgcaacctcaagattagggtttgaatgaaagcgggtttctaaaaactgcaggacgcgcccgcagactgctacccgctgttccactgtttgggcagagttgaaggacagtgtgaaataggagtaatcccgcccagacaatccatagccgtgaagcgtattgctgaagtcgttgcaccagaaaaacagttcccaacgggaacttccgtaaggcgccggatcttcagcttcatactgatagcagataaactccctggcaatggccgccataacagaggccatcacagcgttttttgactcagctgcctgtttgatcctgcggtgcgcctcatcagggccggcatcgcaaatctgacggtttgcctcccgctgctccggggtgtagacatattggagtctgagcgaatggacatcttcccgggcataaccccggtcaatccattttgcgctgaaacttttgacagaagatttatcatgcaatatattcatagtgattctccttttggatttgatgtaaatgcttgccgatgcttcgacaaaggcagtcaacgggatttttcatcgcaggggtggccgccccctccatattccagaagggcatagccgatacaccgggccgtctcgcctaaagtgtttttcacggcttcttccaccacatcatccgtatctgggcactcctgttcgttgttaaggcgtgtcagatcgtggtgcagctctttcatctgctctggcgttaccggctggtcagtttggaccagcacatcggcaaaatcgccgcagccgttgacattcaattctcggatgagcaacattcccataaactaacctccctccttcagcggccttcctgccaatcgtaaagcaaaaggtcatggctggaagccctcggtgggagaacagccgcccgaaaacgataatttgtaaatacaaagccagtgggtttgtgcgtgtactggacggcaagaatgtgatactctcggcccatccagtcggcagattccagaacctgttcggtttcattcccaaaatcaagggcaaaaatccagttatcctgacagctgctcgggtcagagtaaggctccccgcccggcaggaacagaagcttttgtttcatatcttcataactgtggacccccgggtgtttattcaagaacgcttgtgccagttgttccctaaaggtatagaaggggatgaatggcttttttccctcgaagtccccgtttccatccagagcgatcacctgcccatccgagatgatctcgatgataacatcctttcggatgcggcaatcattttgataatcatccggggtagaagtgtaccatgtgccatcaaccgtatcacggttgcagtagtaatagggctggtttacagattggaacacatccttgcagaagcctgtgtcttcaaacagaaaagtgagctggatcgttttcattcgagtttcctccgtagtaataatcatagatttttcttagaccgcgccgtattttggctttggtagggctgccggtggcgattctctggccggagccaaacgctggcccgaaaaaccaaatttcgtagtgggtgcagagataccgcccctttgtgtgggcgattgaaaccgaccacatataggcgtcgccggacaccgtaaactccttgggatagcaatattcccgcattccatccggcgagaaatcatccagcgccgcggcattcccggaacgggggtctgcttgcggctgaacgacctcccggagccagagaagaaaagaaggctccccggcgctcataccgattcctccggcttgccggccctttcatagtagaccttgcgagtgccggcgccgcgaacttggaagataaaaccgggcaccatctcagccagcttgtcagcatacatcttggcgcggtcacaatctgggatcagcatagcataaaccaggccgactccaactttcccttcatgcaaatttatagcgccataacagcggtctccaattttcttcccatagacgatatagttcatcggttaccgccctttctgttaataccagatgaaagtctggccgcataatgcctgaatacgctccatgatggtatcaactttcttttcagataagggaatatccgcattattccagtgccgaatcaattcttccagtgtacggtctggagctgatacacagaaatcacagcaaaagttatagagcggctgcccggtataggcttcaaagacgctttcagtaccatcagcaatccgctgtctctggttcccactgtagttgatacggcctaaataggcggtaccatagcgttcacggtaggcatcaattattttgcggtttaagtcattgtaagtatcatcggcttcatcaatcctgagatacccttcacgagcgagggcatactcccgctgcacttgcaggtagtaggagagggcgtccatgggtttcggatcatgcgtgggatgttttagtttcatcaaaaaatcctcctaaaaaacaagggaccggcaaacagcaaatacgctgtttgtcgatccctttgtgatagtgtcccttgccaaatagcaaggcatttgtcaaataagaaaaagtgtagagttttatttctgtggagcaacattgaaagtatcaatgatacaatactggcagatcaatcagaaaaatcttttaggtgctgaatgatccatgcttgcagctcgtgttctcccgcactgccatttgcaatagagataaacatatccgcaagttcgccgggcttcagttcaagaacatagccgttccatttcagcagcaactgcgtcatcattgcgccaatccgtttgttaccatcaagaaaggcatgattggaggccagtccaaaccctattctggctattttcgcaaggtccgtttcaaaaagatcaaaaccggcaaaggtttgcaacggagcattgactgcggcttccagactatttcggtcccgaataccgtccaacccacctgaagctttgatgatcctgctatggacggcgataacatcttcaaccgtcacccaaatcattccgccatcctcttatagtcgtcagcgaaagaacttaaaaccgcatcggtatccgccaacatctgctcccttgaaatttctgcagatggtgtgttaagagttaagggaaacggcattccattattgcggacaaaggcatttgcaaaaatgttgaatgcggtggatgtggatatgcccagctgctcgcagatggcggccatttgcgctttgacctgactatctattctaaatgtcatattggtatccatataatcgacctccttgcactacaattatactacatatcatgtgcaaatgcaacgagtaggatgcttaattgaagaaggccacgggaaccaatcgtctttgagggagtgctgtatcatctatgcggcagcttctgcaggaggcagctcgttgatgatgggagcggaaagtaaaatggccgtttcggtatcttccattaacagccacgcaccatcgcgccaaacacaagaagttgccttgttgtaaatctccgggaccttattgggatcgtcgatgcactcgcgggtaacgagcaggcacatgtgatcgagatagaaatagtgaagagatttttcaatttcctctcgtaaggtatgggccagggctgcaatttcgtccatatcctgccgttgaaaagcagcctcggaaatctttttcaggcactgtgtttgctgaattgctgcatcaatgtaggttttggcctcgtcaaacaggctgcgccggatacgaatatcacatagagctacatggcgggtgtattcggtggccgctttgcagatttgcccccgcagttcttcataaggtttttggtactttgttttcagcacttccagcgatacgacttccagatttctccgaagggtatccaaatgaatttcaagtgccttgcgtaattctttttcgtccatagttttcctccatttcacaatagaaattacttttgtggggatgcctgctgatcatcctgtaaaatatcctgtgcggccttggatactgcatcccagtaacactcccaataggtatcgcagagatccaggtagtggctgatgcgccctttgatgtccgcattgtgcagcagttgttttttctgatcttctgtcagagccagatactccggcaaagcttgagctttatcaagaaaatcctcccgtgcgcactcatcttcatagactgccgccacggtgcgtataaattcaggagccagcggcagaggccgtttttcaatggagaggtaaaagtggttttcgcagtattccccatccagatagcactcatagctttctgcggtttcttcctctgcaaactgactcttttcacgccatttctcaacgcagccgctctccagttcgtttttcagatcgtcatgaaattgccgctgggcatccattaaattagtgaacggagcctcataagagccaaattccccgtcagtggcccagtgcgagacgacgacataaagcgtaccttggggatacgcctgctcgggaacggccagaggcgtcaacatttcaggcgccatgatgaccagttccagccctaaatcctccacacgctttggcgcaccatagagctcagaaaaagtctgctccagtgcgcggcgggcagcggaaaggtacggcgggtcaaatttacaatagatgtccggcgtatcattttcagtttcccggtcatcatccgtgcgaatttcaaggatgcgcccgaagagcccgctgtactcactcgcttcattggcgaggacgcggctgcctactgtgtaggtgatgttctcatgtgagaatttctcacccggtttcttataaatcatagtccattcctcccttgatggggaaaaagcaagtccccttgattcatcaataaatgtgcctttattatccgcgtcgaaaatgacggcaccgctcgtaaacatgaaaatgagcggtggaataaaagcgatatgcctgctgctttttaggcggcagcagccaacggtggatgggccgcttggcagtaccgcaaactgcaggcttttggcttttgaagatttccatcatccatatcctccttgatagactgtacgcgaaatggtgatcacccttcctccatgtcctcgctggcctcgatgataccgcgcttccgtttcagctccgcgatttttcgcttccactctttctgcgactgctcggcccgtgcccgttccgcttgctgatcttccggggagagtgcagaaaactcccactcccggcgatctgcgtcaatatccgccatgatgcggcgcaccaggcgcagagccagttcgctctttgtcggcggcagctgctccatggcagcctgcccctgctgaaaaagaagccggtaccggtcgtattgagcctcggtgatgaaaccccatccgaagtcatcctggagttcccgctcgctgtggtattgcatcactttctcaaattcagcctgccggacagcgccttctttctccaccgtccgggcatattttgcttctatgcggcgcagatcttccagcacctttgtacaggctgccgcctccatcaaataaccatggtcccgcagtttcagatacctactcatccagcacctccgtttgctcatcatcacagcttaccaaagggcaggcgtaactcttatcaatgctgggcatggtacagcccatatcaggatcatgacaatcacaattcaagcagggaaccagtggctccggctgaagccggattcccaaaacgatgaattcactccatcttccgcagtgtgggcaggggattgtcccgttgtacgcatggtcgatctgctcttgtgtaacgggggaaatcttatggcagcattcgttccgcacatatacgatatgagcggctcgccagacttctggacggtatctcttattgaaaggaaggtagccgccccattgcggattgtcgaaaacccgatcaatgtgtagctgaagggcttcttttcgcagttcagtggctgatgccccgatataattgtgttcgctgcaccattggatcagatgctttagcagatgtgtctccccatcgcgttcgatgacagcctccgccagcctgcaccagtccttttcttcaatctctccaagattggtttttacaccgtcccacggcaaatgctttttatcccggccggagcccgtgctgttacagcggaatacgccatattgccagcgaatatcctcgtaggtgatggaagagaagtctactccactgggcagatgatagtccacatatttcataattttcaatgcctcataattttcacgactggtcagatcttgttttacacagtctgactgctattgtgaatctctccggtttgcatgaggccagcagacgcattggtgtcttggcaggggctgtccgatggaggaatctcgcctctcaaaacaaaaggaagaactgcgttccagctggtcaggggaactggattgccgtctatttcccgcagagcctcatccatccagcacttttcgcagatatatacatgagcgtatctgctcaaactgttcaggaaaaaatacagcccggagtataattcgttgcggccgcaccgcgggcagagaagctgctgttccgtctcctgcagagggcaaagacgctcaagaaatctctttgcttcgtcttcagaaagtttcatattgtgtcctccattgcatttcttaaaattttattggcaccaacttggccgatgccggtataaggtcaagcctgttatgcgatggatctctttgtcgttggtgacttgaatgaatccttttttgcgggccacaaccctgacctcctcattcatatcaagacaaaatacttgttccccgtccatcttccggagttcttgcgtggtaaggggaacttcagcggcaaatttgttttcaggcggtataagcccggctaccagcatttgtactgcggtctgaaaaccggactcaaaagcctgctcggccacaatgctgctgcactcaccggcggcaagctggtacgcttcaaaggcggccatggcttccggggaattgcccattttctggcgcaggagttcctctgccattgaagcattatggttaagctgcttctggtgctcgctttgtgttttgaacacgctcggctcataatctccatagtagagatcatgaagaaaatcagggtcagcgacaaaatcggctgataaggactgcttgggcgcagacagactttcggcgattcgttccagagccttgataagattaggcagctgggaattgaaaaatctgcggccatattccgtttcgtgcaaattcaaaattcgtcacctccatatagagaaaaaccgccagtgccttcgggcctgtagcggtttatgtgaggccccagaacagggaccggcttcttgattgttcatgaggacaaaccgcctgctcctttaggcggcagaggtatctgtccctgcaaagtcacaacatacgatttcgcatattggcgcggtgcaatgccagtcatttttatagtaggccgtgtcgatcccttggttaaactccaataaaatcccagtccttttttcaaatgttctggcacgcccttcctgaagccagcgatggtcttccgttccgctatatacgaatggcgcgctcatttgcggtattatgaacgcaccttcctttgcaatacgggaggccgcctctattaccatgtattcaaattcgccgctcatgtagcttttgcggtaattgtttgcaattcgaccaaacggcggatttgcaatcgcgaagtcaaattggcccaagaggtcaggcagaaagggatcaagaacatccgcgcatatccatgtggcctctggcacaacttttttaccaacctcaacatagtgcggattcagttctacacaggtaatatcggcatagcagcggctacggtcactgcattccagctgtgccgcatagctcagtacgccgattccagcacacaggtcgataattctgatcgtctttccgtataggcacggaatctggagagtaaaatcgttggcaagtccaaaaggagtaaaaaatgcaccggacttgctattgatgtgctccgcgtcttcccggaaattttcaaagataaaaagcttatcttcgtgggaaaggtgttctttctgcaggagacaaaccgcctgatcgtggagctgaatttctcttttggtcagcttactcatgggtatcctccatttatgtggtttggtacagtttagacagtgaaaccttccatactgcagcgaagaatgcagtagtcggtccgaaggcttttcatgtgccgcagaatatcttctttggactggtagccctccaaattcaacacctgccgttctggacaccccttctcgctggtcaggttgcagtaccagtacccgcttttggtctggtagaccttccgatttctcttgtgaccgggaatcgtgagcgtcaaatgcagaccgccgacgccatactctgcatgaacgagcataaaagtcgctttatacagctcgcgttcttccttttctacaaaaccgcagaggtcaggcagcctggggcaccttccagatgtgtggggcatatcgcgccgattccgttggaattttccccggcaccagcaatcccgcacctcgcatttttcacaatccacagcgccatgaagcggtgggaaatagtgttgctgctccatcacatggcctccttaaaaacagtcattctgcattactttttggcaggccaagtccaaaccagctttcagctgaggcatggcctccatgtattggggagtgatacccagggcatcaagcgtgtcttgaacatcgccggtatagccgtattcgtggttggaaagttcagtcaggaacatttcataaatgaaattgtctccagctttatcagcggcaatggcctcctcaagctccttgcggtgccgggcaaacatttcatgcagcttcggcgcatcgcttttgcggtaaaatccaccggtgccagcgatcgcatacacctgattcatgtcggaagggcgcaggccgagccggcgcattccctctgcgaactgctgttgatcgaacgcaaaaaacatgggaaaggcgttgacttcctcctgctggcgattccgcagctcctgatattggtttttcatattatgcggcctcctttttcctctgctgtacagatagcctgacacgccattcttctggacggggctgactgcggcaaatccgttctaaaaggtctttattcgcacaaacagcatattgcttccactgaggccctggcccttgacgggtcaggtgctccaaggcatacatcatcacagcaccctacctttccacctcgaattgccgaagcttttctaacagcaggcgggtgttctgcgcgtattgctcaaggaacggctgatccaaatcgaagttataatatcggtaaaacagcacttggaaggtcatctgtttgcatagttccggagagatcgagcgcatccgcttaccgatttccgtgatagcggcatattcctgtttcaaatactctttctccactctggggaaattgcgataaaaccagtctttgacggaaacctttccgccgttgaaatgatactgctgattgcggtcaaagcagaggcagtattcaaaatcacggccccgctcgccgggtcctacagaaaagggatagagccggcaggtccgtgggcgtgcctcgtagatgctgcacaacccatccttcaggaaaatacaggaatcgtccggccccgtggttttcagcatgaagatgggaaagcactcttgggtcagcggcataggctcgcagtatcgggtcaacacatcgtctatagtgcagatgttgggatcacagccacgcaaatagtttgccaaccggtaggcatccaggctctccaccatcaaactatccttgatatgacggcagcattgtccacacctgcggcactggtagtccacacagtctttggcatgaacggacactactattgttttttgatcatccatgacaatcctccgaaaaaagggccgtggcgggaaatccgtcacggcccaaaacatataggacaagctctgttgtcccggtatcttcttacaaccgctttacgcgcacacggccagactcaccatcgggagcgggttgcaggccgccagcggaaaaggggccattgagaggcagtaattggagttgagcgtttcaaagcgtaccatatcatctgactgatcgtggatggctaccacacgggaggtatgatagatcttaccacctgcatgaagaagtgcgccctgtccaatcaccagcggacgcagaagtgctccgcgcatcacaatagatttttttgatttcgtcatatacttcgacctccattctgtttgtggtagatagagggttactcgcggcataacctcaaaaacacagtatggacctcatcaagaagttcctggatgcgtttcatcggtattttttcgtggctggaaatctccctgatgccatagccgtaacccttcatgcggacaattttcatctgttgttcagaaacatgggaagccagatcatggagcatctgctgcatttcaaattcctgcatgagacggtcctgacccggcagcacctcttccagcggaacgccatccgagtataggcccagatggatgctgatgacttctgtattacgcttgcggcgcgcctgtgtacggaaataatcgtataagcgaaatttcatttgtcgaatcgcaatagtgctaaaagaatacttttgtgcagatgcgctattacagtagtcctgcacagccttcaaatacgggaaaataaccacatcatagaattcattctctggaagatggttgtcattgagaaatttatagaccaggccatggtgttcagcggcaaaatcctgctgctcctttgtcaacggtacttcacacaacataaattttcctccgttctaaataaaaaagggatacctccgacttacgccggaggtgtcccttgatgatgtatcatgcggcattgccgcaacaaaaacagttacgccggcaactgttcatagtcgccgttgatctcgccgaccacatagcttccatccgaggccggggccgcagtggcagattccgggatctcatagtcgcaatcgttggcccgctgttcctcattgatcagcgcccgctgaatgttgatagttttgatttgccccttgaagacattggcataggcgcggatctgggccagctcttccccctggaaatcacgcaaaaggcggaaagttgcaacgctataatcattgctgccgttgctatctttcttgaggccgatctggaccagactgccataggtggcacgctggcgatagacaaaagccctgttcaggaactccttgaacggcctgatgctggtgggcggcagggagaccagcagaggcatatattcaccactgcgcagcagatagagatgcctcatattcttgcacgccttgccgcggccgccatccttggccgatccatacgcattcatggggcaggtagcacacgcacctcccggtacgccgatccctgttttgccatctacagaggagcagagcggtttggtgtcttcgtcatactcgctgccttccggccacagagtataggcagagtggttgtagaggatgatgccctccagcgtccgggtataatccggattgtcgggatcttccgtgggaacttcaaactgcagggcgccgccggcgggaatcttcacccgctggaagctcatcatctgaagcccatccgcatcttctgcgatctcatcgcggctgaagtcgccctccaccatcgccggaagcaagaatttgttctgctcgtttgcggccaccatagaagtgttctgttcgtacatagttcattcctcctgttaattttttgatggatggcagccatttaagcggccatctggttaattcggctccactgccgtgccggcatggagagaatgttgtagccgatgccttccagcgcggttgcccggtcatagtccttaacatcctggctgtggcgcgttacggcgttggacagaccatataaggtcagatcgttgccttcaatcaaccgctgcagcacaccggagctttcatcgtccgtgatgtgaaaatccttgcttacgagcttcacaatgtcagggacagcggcagtattcatgggggcatccttggcttcccgcatcatgttgaccacacgggtaaagcgtacctcgtctactacggcccgcaccgtgtcctggatcttcatggcgaaggctttgtcatcggcctccagcgtcttttccgaatacagctggtagttctccgaagcctcattgacacggcctacatggttgcggcgcgtctgggcgtcgtttaccaccataccgttgctgcacaccagacgatagaccagcggctggatgctcaccgagcccaggcctacctcgctgttgctgataataataccggactgcacgatgtcaccgggtacgacctctgcctccaaacgggtgttgacaaccttgatgtacatacggctgtcggtgagctggcagctctcaaagtgcatcccttccatctcctgaaggactggaaggacaatcccggcaatatcgaggttgtcgatacgccggtagcggttgctgagaaacgcccgcgctgtgccgtctatggtgcgaaccatacgcacagccggctcccgctggaaccaggcattcacattctgcgccagcagctcggggtattcctccagcatcttgtcataataggctgccgggatcttgaggtgcgttccgatctgcctgtgtgcgatggcgttgacctccagcggctccacggcataatcaccggattggtcgtaagcgttgagatacagcccgccaccaaaaggctccaaccggagactccgggtgtccagcatataatcggccttcaaatcgttctgccgctggatttcctgtgccatttccacaagactgatccctgatttcatgttatttcactcccttctcatgacgatggcggttaccaggagacctggatgccctgcgctgttgtttcagcagccagaccgttgctctcaaacacttccaccagacgaggccagtagacctttgccggaaagttggaaagatgttcctgcgggacaagctcttcaccctgctggatgcagatgtccccgttttctttcagtgtgagtttgctgtggccgcgtgagttcaggtcagcaatcagcgtctccatgactgtgcgcccgttgttctcataccagatacgcgggtcgataggctgcttgttgggcgggatgtctgcctgttccccctgttccgtccccgctttagacagcggtacgatcttgagcaggtcacagcgaatggttgcgtccttaccgaaggtgatgtccgcatggtcgaacgcctccacattgtaaaggcggatacgccctgtgccgttgctgcgaatcaaatccgccggcctcttttcacaccactcaaagcaggcgttgggaaaagatgaacgcagataagtcaaaatccggtggttggcatagcggagcagcagatcgtctggtacaggtccttcaagctccggcaccgtaaaggtgttctgcgcgataccctcggcatggagctggcgttccctctgctgacgctgacggcggcgcctggcctgctgcatataggggagcaggaggatcagcacgacccaaagcccccagagggtaaatacccctatcagaagccacgcttgccagggtccgcgtaccaaagccatgatggcgatgacagcaccgatcaggattgtgatgctgccgctcaaaagtcctttgtcgttactcatgttgttaccgtccttccttttaagttttgcttgaaaacaaaaaaagggaccgcaccaagcttcagttcattctgaaaacttgatacggtccctcttgcagtgccggattttattccggcagggattcgcggtcgccgtccattacctcggagggggctggagcggttgccgctgcgtcagagtcatgctgctcatgttccgcttttgctctggaagattgcccaggaagaaagccaaagtccgtcagccatactttcaactttttgactgtggccccgtccttttgccgtacatccaccagtttctgcgatccagtgagccagatcatgcttccctttttgaccttgagccgtgcgagccgggcagcctggtcgccgcgggcccatacttgatagaagttcggatgttcacctccggagcgttccatcaaatcaaaacaaacatacggctgctttgactggctctctttgggagtaagctcgtgcatgactcggccaaatacatagatttgtgccataacactcctttcttcgccatcggcgttactatctatatataaaaagtgccagcggataccaacccgaaaagggcgtggcaataccactgacacttgatacagcatacaaacttaactgcgtgtgcaatgcagggctttgggccttgcggtacagatgtttcatctgtatcccacatggggaacgcacaaaaatcaattacaggttaagtgtaacaccgtatcttgtgtttgtcaagtgatataatactatatatagatattttagcccggcgagttacaatatgtggttcatgtggcggtagtaatcgtccaacaggtagaatttcagttccttggcccggggtgtaccatagttgaaggtcagcgcatagagattgcctgttccatctataccgagggggccgagccagcagtcggcagtgttgccgttgagataccagagctgaatgtcctggtaagcatcttccgaaacaagccctgatgcggccagacgctgggcgtcttcgtcttcaatcagggtggaggaaagaaaacggcggtaaagttcatccggcagaccgagagcctgttggtaggtcagcggattcgggtgattcagccaccagcgggtgacatcttcaaaggtgcgcagatgtggtttagctccaagcgcccgaaagctgcggatgaacgatttcaccttgtccggggatggcgcagaagggattgggatttcacgcacttcgttgtctgaaaaggaaaaggcaatccgctcaccgcatctgtcctccagcatgagtgcggagcgggataatggagagaccagaaagtgctccatagcaaaggtatgatccagaaactgttggattttgtattgctcaatcgtgtgtggtttgtacatgggggtagccctcctttttagattctacctattaaataggaaaaatcccccgtttttctgcagcaaatcaaactttgtaaaaatagtggatagaggagtaagaaaaagagatacgatgctgtggttatgtagcctgcaccgtatccctttcctattttgccgtaggtttagccgttctccttagcctgttcctcttggacagccggctcgccaagggcctcatatcccaggaagctgttggtggagagagccgcgtccagatagtcgtttccaacagtggggtggctgctgctttgaaagtaaaaacgataccgggcgccaatctggaacttggcggacttacttaacagtaaagtgcgctccgcaccttgttcgtctattagttggatcttgcgatactgccgcatcataggcgagacaacgctggagcagacgccttctacgatctcatactggccccgggcgatggtgctccataagctcctaaccagtaccagagaggcaagaaagattatgctgcccagtaccagcaggatatggtctgtggtaataatgaagatgattaggctgagggcaatgcttgcgagcccggccaaaaaggtcaacaaaatctttcgccgcagcacgaacgggaattggttccattgattcttcatgtggtaatcctctcaaaaatgatttgctggcgcaggtagaggttggcaacggccagcgttactgcctgactgctccggctgtttttcattatgccggcgatattatagcaggtggtttcgtcgtcgccgtacacggcctccatcaagaactgctcattgggaagataggcaacatcctgctctacacacttgatgatctcggcggtggacagcagagcttgctgggccagcctcataacacgggtctcatagtcggtacgccggtctttttggaataattttagcgcctgttgaatagggactcggcggcctgccaccagtttgacaaatgagatgctcctcatcagcattgatccgctggctggaataatgccgagagaactcaacaaatcatacagagcatcgtattccgtttcaccgcagccagataccagcagacctcgggtgagcagccgatttacgcaggcatcccaagagcgggaaatacaatctcccagagaggacaccagcttgtcacactggagggaaatatcctctcgtttagaaattcgccagtttagggcggtccaaacgaccatttcctgcatatccaccatgtaagtttgcccgctcaggcggatgaccgggcaggaccggccacagccattcgtttcccggtccagacggccgattgcagtatatagggttttctgttccattcatcagtacctccttcttttatatatcctttactgcggaaaggccgcggttttcaacaaattcagagcaggcttttcaggaacttggagtctctgcgcagttttgcggtggaacgcgagatccatgcccccacatgggagggcggcacctgataaagctccgcgatgtctgtgacccgcattccttgaagtttgagggcaagcgcctcaatgccaagccgggttacaccatcgtaatcttttttacaggcatccagcaatgacagagtttctatcagagatacttgggtgttaaaggtgtcgggccgggactccagggcctctccgtctgccgccagttctccatgttctccaataataagcctgctgaattttttcttcctgttgcagatcgcccggcaataggacagaagcccgtttttaacgaccgttttggcgtaggtagaaaactgggcccgtccgtcattcttataagtagacgcggctttacagagccaaaggcacccctcttggaacaggtctccatattccataccgcaaatagtcggattaacatggatgtagtcacaaatgacccaatgtacaatagaaagattccgggcaacaagttcctgctgctgttctgttaaactggtcatcgtttcaccccccctttaagcggccgaatgcagattgcccaaaggagcagcggctttgtaacagaggcgaattacctcatcgcacatcccgtcagaaaacatgccaatatgtgcctgctggtcatttagtcccagtttggcctggagccagatgtagacctcccatttttccatgtgccggctctgctgcagatgctccagcgcccggtgagccaggattcgtttgtgccggagatccccatttgccagagtccccataggccggtgtgtccggtcatgggcactcacataggcatcacaagccggccagcgatcacagagatagatatatttgccctgggaacggcggttacagccatagactgtgctggcggggcgaagagaggcgttagcatggcaataagggcattggatatgtttttgcttcgtcataaaaatcatcacctccaaatgcgtatagatgacggcgcaaaggcgtctttcagtgtgaaaaaacagtgttaattgcagcccgggtccagagaaagttgtctgagcgcacaggcggaaggctccggtgtgtgccattcgatgtacttggaaaaggcggcgtcaaaggcgcgccgggacaaaatggcaatgcactcagacgaatctacagtttctccggatagtctttggatgtcctcggcagaaagcagcataacctgtccgcactcatccacagccagaagaaaaccggaacagggcgttgtccggccgcacatgcagtggccgcaatcgcagcttacaaagatagcgttgcgccagttgccgcgaacagcccgcaggaaagaataaattttgcaggatgatttcatcctctacctccgttattcgttttttcaaaaactaaaaaagcggggaccggccgtggaaacccacagaccgatccccgccggtgattttagccaaacaggccctcgatctcgctggtgatacgcggaatcaccgtgtcgttgaaaatgagggtcagggccgccagaagaagggcgcccagcactacggcgatgatgatcttaacagcgtccgaaatgtaaaaatcaccgcgctggttggaaagcgccatacgggcacgaagggccagtgcattcgccttgttctggatacgggtggtaaagtttctcatggtaagacctcctgaaattttattgttttgatgttgatggttttataaaaagactgctcaccgctcaagaacgacgaatcggtttgagcatgtcctttttattggaaatgggccggctgggataggctttcggcttttgatacagaagccatcggaaacggcgcttttcttcccgtgcgccaccagacggggaaaattttttcttaggcataaaagtctccttaaaataagggccggcctgtatatgacaggctggcccagaaataaatgacggcagctgactaccgctacaaaaatccgctatagaacaagcacttacctcctttacactgcaagaggtagaaaaatgtgttttttctgcttcatacattcagaaaaatgtgaaaaaatgaattgcaaaacaaagaaaaatgtggacacctcgaatgtgcatcatcatttatcacgaatcttccgctgtatcttgcagagaaaaccatagagctcttataggaaacggccctcacattcagatgtggggccgttccattcgcagtccgattatccaaagaaagcgcccaaggagcccataacctcggtacagaggaccaccagatagatgatcatgatacagatgagcatcatcatggagtaacgctggattttcttgggacgcttggcagcttcctttttcagattgttctgctcaatctgtcgcatatcaaaacagatcatcttgaagtacatccgctggtcatcgccgcgaagaacaccgatcagtccccggattacatcagacagcatggggctgccgatgcgggtttcaaaatggatgagggcgttttcatagtttccggtcttcatgtcggcaatcgtctggtccagctccgcgccgaagtcttttcccgccacccggcggtaggaagtaaggatcttcagcacatcccggtcgttttccaaattctgcccgatggtaagggcaaagcgcgggatctcattctcaatgagcttgcgccgctttttcacaaagtcaaaaaccttgtagtaggttgaaaaccacagcgccacggccagaccaatcagaacaggcaccataagcggtatcagaaacgccatcagcagagaactgaggccgactgccccggctgtgacccaggcccgggcggtgtagacttccggtgtcagctccatggcggcaatgtccagcgcccgctgcagtttattccgcttgagcttgtccaacttcaggtacggagcgatcaggccggcgattttggtgatatagacatccagcagtttctcggcctttacgccctgctgcttgcgggccagaagcatcatacgggaggtgcgcttggtgggaatgtccgcaaaggcacaagtcaggttatagacggcaaagccgaaacaaatcactgctgtgagagctaaaagcgtcatgcgctgtcacctccatattcaatgggcctgctcagtttcatgatctgggtcagggcaaacaggataatggctgcgcagattgccaaagcgattttgcccggcgtggtgaagagcagcgtgtgaaaccaatcttcattcaggaaataaagcagcggtacattggcgatcacaaggaacatcatcgtgatcgcctcccggcgcggcccctgcatcatagcctccagctccgactgcaccacacgaacatcagaaaacttctgggcgatggtaggcagcgtatttttcatggcccggtcagactggcactgaatgaggatgttagcccactcatggaaaacacggtttggaatcttcattttgagcgaattgatggcactcgtagtatttgcgttgatcaactctgcctcatagacaaatgcctcaaaattggccttcaccggctcattgatgtagggcaggttttccttgactgcccggatcaggtcctccgtgcgcaggtaggaagtggtgatgatggagatggccgtttccagttcttcattcaaatgctttttataactggctgcggtgctgcgcagataccaaataggagcgagtgaaaatccgatccctaaaatcgggaccatgtacacattgccaatcagcagcgccagggcaccgcccaccgcgaataggatcagagacagccgtttgactgcttcataccggtcagcccgcccggtgcctttgagaatctgcttcaattcaaagtcctgattaaagaagcctttggccggagtgcccatcagaacattcagttcatcggtcagagtggccgacttgcgctgtgaccggaaaagcgcatcaatgaaatcgcccggccgcacaccaaacagcgttaggagtccagcggcgatgagggcgaagcatatgatgtaaacccacggcatccgttcaacacctccttgtcgtgctcaagaaattcatccagctccttatgggaaatcccattgtccaggagacgcttctgcaatgagctggacatctcggaaacttttttgtggcggccgaccacaagaggccgtccatctgcatcaacagtattgtccagcacattgtaagagtagagggtgcggtaaatcagccgttccccctcgcagccttctccttcgatgatctccatgattttacggctccggtcttccaactgctttgtgaacacgatgattggataggcttcgaccatgatctgcatcaaaacatcatcgcccatcatatactttcgctttgccagcgtcatcatgcgccggtaagtggaggcgcaactgttagagtggattgtggtgcagacggtatggccggtacgggagctttcagcagcggacaggctttctgccgcagaccgcatttcaccgacgccgatcacatccgggtgcttgcgaaggacccgctccagcaggaagtcctggttgatgttcaaggatggattttcactgggccgggtgagcagatggactacggaattcagaatgtttccattttcgtcccgcttgaccagatcaaattcgcggctgccttcctcaatcgtgatgaggcggcggttgtcagggacctgggacaacagccatgccatgatggtagttttgccggagccggtggccccggcaatgcagacggatacgccatagcggatgcaggcggtcagaaaatggagcatttccgcggttgcgctgccggagtccagcagcttctgtgcggaaaccgtttgctgattcacgatacggatggaggcgttgatccccacctccgggtcaacaatcggtgtcttatccacagagatacgcacattcttatccagaaaaccgatcacgctgggcatggtatcatctatgaccatgccgcaggcgttgagcatacgccggaccacatcaatggcgtgctgtggggaggaaaacttgtccgggatcttaacgctgcgtccgccggcttcaattacctcaatgtcgttgtaagcattgatgttgacctcctcaataccaggcttgtagatccactttttcaggaaggagtacccggccatgtcctcatagagcttctcgcacagctcctccgtggtcagcccctcgatggcgtattttcgcttgacgatgtactgcaccatcagttctttcaaaagggaggaggcgcggtcggtatttccatcgccggcctctgcaatcgtggcggcgtggttttccgcaaagtaccgctgtacatcttccagaatctgttcgtaggtaagttcctgatttgccgaaggtgcgaagaaaatgtcattgagattattcatcggcagtttcctcctcaaaatgctcggtttcgcttacatcatcctctgcggcatcgtcagccagttccatctgttccagcgcatccaaaaccttgttgagtgaagctgtgtatttggggttgcagtatttgatggcctggaacatccctccttcggtggcgcaacggtcaatctccttgccataaggcagaagaccgtcccagccgccgatgatatggcccatctcatccagcgcatggaaggggcgggccataccggcaaaggtcatatgctgatcgtaatggaagcgtccgtctcccaacaggggttggtgggcctttaagtaattaacacctttgaggtcaggcgtcaggatgcgaatgaccagatcccctgactcaatggcggcaggcgtgaacacattcgtcatattggagctacagtccagaatgacgaaatccacaagccttgcggcggcattgaccagctggagtaccatggcgtacttgacttccgggtaactcaacggattttcaccggcagcatagcccatcacgccaatgaagggataacttttgagcacggtaacatgccctgccaccaaagaggtatcgatttccacgctgctcagtacctgccctacggaggcattggtctgaatgatctgctccggcagccagacagggagcatggggacactgatttccgcattgatgatgatcgctttccgcttgtcgcgggtcagggcttttgccagaatgcaggaaaacatactttttccgctccctgggctgccccagacggtaataacttttcccatagtcgaaggctcctttcaaaagaggtgggataccccttgactttttcattgtcagttgtataatataaatgaaattatcataaaataaattatgataaaggaggtagcaatatgaaatttatcggcagacgcagggagttggaatcccttgaaaccgcgtatcaaacagacggcggctttgttgttatctatggcagacggcgcgtgggaaaaacgacgcttatcaaagagttcatcaaagacaagctcgctttttactttctcgcaacagaggaagtagaatcccagagcatgaagcggcttgccagtgttgccgcacggatcacgaaaaatcctatgctgcagagagtcgcattttccgattggctggatttgttccgtgtgatttcggaataccgtccggaggagaaaaaggtgctcgtgatcgatgagttcccgtatctggtcaaatcgaatccggcgttcccctccattctccaaaacgcatgggacgagatcctcaaggacagtaatgtgatgttgatcctctgtggctcactgatcggaatgatgcaaaagtatgccctctcatatgacagcccgctgtatgggcgccggaccgcgcagatccgccttgctccgctgccattcccggatgtgtatgcggcacagagcctttcgtttgaagatgcggtgaagcaatactcaatcacaggcggcgtacccaagtatctggagttctttaatgagcgggacgatttgctgcagcaagtggaatctgttatcctctcgaaaaacggctttttatatgaggagcccaacttcctgctgaaagatgaagtgacctcagccgtaaactatttttccattatccgagtgatagcggagggcaatcataagctgggtaaaatcgccggcgctatggggatcgagacttccggcctgacgccttatctctctaccctcagcgatttgggctttatcgtcaaggacacgcctgtgacggagaaaaatccagagaagtcccgcaaagggctttacttcatacaagataactttgtgcgcttctggttccggtatgtctacccgtataagggagaactggaattggataactcccggctcgtcatggacgagatcgaaaaagattttgaacaaaagtttgtagcctttgcttatgaggatgtctgcagggccgtttttgcggacttgtgcagaaacagggaaattccatttacgccatcccgtataggggcctattggctgaatgaccttgacagcgataccgaaatcgatgtaatggcggtagaccaccagaatcatcaggtctttgccggcgaatgcaagttccatgtcaagccagtggatgcgccggttttctttgccctgcgggacaaagtgcaggtgtccgcagaaatccaatcagcattcaaaggctatcagttcctctacggggtgttttccaagagcggctttactccacggctgcttgatatggccggacagaatcccagcctgttcctgatcaacgaggacaaactcatccaaacaaatacctgatggtaaaaccagggcggtgaagcgattcaccgccctggttatttgctatcctcctggccgctttcaggggagacggtttcaggctcgcccccttcggtgttttcggcgtctccttcggcggcaggctcgctgctttgcgcatcagcgttttcatccaccagcgtttccgggaagtaaatttcctggagcgtcttgtcctgttcggccagcagttcttcagccagctggtcattgttgcgggagatcagggccacatgagctacgccgtcgttctccaactcagtgatgatgcgggcctgctctgggcttgccagcactgtgatggtagcagactgctgcggctcttcatcttctgtgggctctttggtattgtccacattgataccatcagaatccgtgacggaaaggaccttgacaaaacgcagttcgggtacttcttccgcagtctccaggaagtgatagatgcggacaatatcattgggctggagcttatccgacagcccggaggccagtgtttttacggtcagagagatagcaaccttaccagaggggatgtcattgagcgccacatcggaggaaatcgggacgctgctcaccttactggtgagaatatagtcgcccgcagccagatcggccgtcacatacaggccctccacatcatcaagactgtgagccacattggcgggaaggttgtagccgccgacctccacaacctcggcgttttcttttgtgacctgctcgcctttgagcacaggctgggtgatgcggacaatttccgttttcccgttggtctgccgggcaatggtgggcagagccacaaaagcaatgactgctgccaataccagggacaaaataccgaaaataaatcggttgttgagtttcataagcacattctcctgtcataaaaatagttcagccagcgttgcaacagagcagccgcaggcaagaaaaggtaagaacgggatggcgatgggctggcggagccgggaaagccttcggaacagaaggaccatcggcatggcaaagactgcggccacaaagaaaaccagagccatcccggaagggccgtaaatcagcccaagtatcccacagaatttaatatcgcctcctccaagcccagttccacccgttgccatggcagcagccagagggatgcaaaagccaagcaatgcccccgccaaagcctcggcaacggtgggccagagctgcccaccgtccccggcaaggcagaccttgagcagcggagccagagcggcgaagggcataaaaaaggcgagcgcccgatccggcacccgcctatatagaatatcgtaaacagcaaaaccagccacaacagagaaaacggtgagcaggtatgccggccacaggctactcgcggttggtgtaccaatcatcataaaggctcccatcgattgaaacatagtcgttcaggttgatgctcaacattccatcaggggtccaggtgtcccagacttgggtgaagacggtataatctgtggaatccgggaaccataacggactgaaatgcacagcccggttataggtagagaactcgttgggctggaaagtgaatttggcactccggccgctggacacccgctgcagaaggcgtaagtatgtttcgtactggaactcgggaaacacggaaaatgccgtctgcggatgggtgatatggctggtgggcgcgtcggtagaaagggtggctgtcacatcctgcttgacgccatacccgctcttcattgacttcccggaggccgtgggcacaatatcatccggcatcagggacatcacaccgctggtggaggcagaatagccggtgtactcgtattcccaatagccttcatcgacccagtgcccccagtcatcgtggtcacaccaaacccaaaccggtacccagtagcagctccatacgccccagttggcagtgagcttctgcggctcattggggagtgagggcacggtgtagttggggttggtatccgttgctgtcggatctggagggatatgttcgttcaagtccacgatctccgcaacaaaggtatcttgtgcggtataggctccgctgacggaaaccgtgatggttaccgactgtggagtggagggcgtgtgccacttgacccagaccacctggctgtcgcccgccgggatgactatatcattgacccggtaggtggtgccgagaatatggaaggtcaccgaggccggattgtccggtgttaaatccgtatccgtccgcagagtgacggatgtgatcacatccgtgtctacccgatattctacatcgggcgcttcaatttccccttcgggcgggcgctcatcaaaccagacgatgccgacgcccagactgctgatgatgtcagcgttgctctgcttgcttgtggtgctgcctgtccatgcgggcaggccgagatcgctaaattccaaaaacatcgacagaggcagattcttgtgggtgagggaagtcatggttttccgaagcgccccgccggatttttggtcatacagcgccgcctctgtagcggtcatacagtaatactggccgttatgcgtaaagtatgcaatgggctcgatcagcagcttatagtcgccagcgatcatccgctcatagtccacaccggccgcctgggcaaccatctggcaggcatattccgaacaaaaataccgcttgatggcctcaatattgctctgccccttgctgctgacgatggtgggcatagactgcgctggtttgatgcaggagtatgccacgccagactggagggagagtgcggtgccgcccagatactgtaacttgttgactttcccaaagtgcaggacgctgtttttttgtacccggttggagaagtctacgggggaagatattgctgtaccgctatcggcatccacaacggtaattcgcacaccatcatttccaggattccagaaattagaggatgtgccttggcccatgctgccgccaccgccgtcaatatttccgttaccgccctctgcaaacgcagtggaagggagcaaacaaaataccagggcaaggctgcacaggagggcgagaagtcgcttcaaatacatcacactccgttcttcttaaaatagaaaggccgccacagctctgtgacggccaatcaaggttatattcagttgtagatgggtcagcccatattgccgacttgcttgttgatgtcaccatcactatcaccaacagactgttgaacatcgccgggaactacccacccaaacactggatcatacacagcgccgttgccattgctggctccgggggccggctcgttattggccggctccttttccgcagggggagtggtgaccttgggcacttccgggtcaggattgaccggatgatcttcaccggggtcttcccgctcggttttcccttctggcgcgggcgggggcgttgtttccggtttctccgtgtccgtgaagtcgatcacgacttcatcctcagtttcagaggtcaccttggggtactcctcttcaggactggaggactggccgggcgtataggctccggctccgctctcaccatctgtctgtgtaccgccatccgaccaatcgctggtcgtgctgctgggcggggattcttccggcttgaaatcttctgtgcagtcccggctggcgaaccagcagacgcccaggatggcaacacagaggacagtcagcgaagtaacgataaagcctttggattgaaaaaacttcttcatgtgtgctacactccttttttgctgttatataaagcctatactgtagttctgactgaattttcaacagcacagctaaaatttggtgttgtggtacccggtcagctctacccgctgggtgatggtaggataactatgtccaaacatccgcacataaaagtcaacatcacagtaaaagatgtactccacacgatcacccaccacattgaattcaaggctgatgtcggaaactgtgtagtcatcggtagagagagggatcttttcggcaaggccgccggcaactgtggcctccagcatttctgtgtagtcccggctggagtagagggtgcgtaaatactcttcaaaattggtttcccgttgggagcggtaggtatctgcgtagatggtggcgctcagattgttcagctccattttagccccgttgcggatgttgatgcaagtaattctcaccgaggcatacagtagcaggaaagagatgagcatgacgactccaaccacaaagaagcaggcgaagaaggtgatctccccccgctcgttgcgaagcggccgatgcagccgtgagaaaaaacgcttcataggccacctcacttccagtaatgttcgctgacgccggagccgcgggccaccaccgtgatgttgaccagatccagattccagaagccgcccagcttggcatccccctcaatggtgatatagaaaggtgtccccagctggatggcccgggacatcccggaaggtgtgggagatttatatgtggcgtcaatcgaataggtgatattgtcggctccctcgatctccgaacagaggaaatcaaagagggcatccgtctcgctgttgatgccgccggacaactggatctgcttgaccatctgatcggctgcatggtccagctcctgttttgtagagatgatgccgaacaggtcgatgataaaggccagcaaaacaacggcaatgaagataaacactaccgtggaaaagtagttggcctcaccccgctcattttttaatgccctgcggagcttttgcagtatgctatggataaaaaccaccacctttactcagaaataaaaacagccgctcccggccggagcggctgcattacaaatttttgactgtaccaagtataacagatatggatttgcggctcaagggcaaggctgtgccaatgtagggacaatcctgtgccaatttacagaagtgattgcaaaacatagcggatgccggggcaggattggctgcatggctatgaagtagctgaaataataaaataaccgcccgagaagcagttatttgatacttcccaggcggttttcggtttacagattctgccggatgatccgggtgatgattccaagagcgatgccgcgctccacatccaaatgggtgacggcaaaggatacatcatccttctttccgggcatccggtagtcatagcaggaatgagctaccgcattgacgccattggcaagccggacataaaccacacccttgtgtacatcggtcacttttccggcgtatttaccctggattcggcacttctggagattgtcccggtcggtattttcagatgtgctcttgatgtcagcacggattccgaggtcttcaaggctgttgcgccgcacattgagaatgcggaccagcacttcatcgcccacggagaaacgctcgtgggcatcgccgatccagtcccaagccaaatcacgggccagaattgaggtttcaacgccgaatacctcgacgcggatgaccttctccgcaacagcgatgacccgggcctgaacaatacgcccctcgtagatgcggtacttcccctcggcgtccaaatcgaaataaaaggtctgacgcttccgcatcatagcctcacggcggcttgcgacaacgctgcgggtcttggagtcgatgccgcgcaccacaaagtcaatgtccgcccccagcatattccctaaaatcttgttttgacgcagcatcaggtcagcgtactcctgaccggaagggctgcggcccagattgatcatcatctccttgatggggataatgatgcggaagcccttgtaatccactacggccacagttttgcggttgtccagctgctcaatgccgcccagctgacctgtgaggatgcggcgggtgcggtaggcgttgtggatctcgtgccaaatgacatcctcgcggtcttcctgtgtttccacctcttcacgactacggatggtcaggatagaggcgtcactgcggtgtgttacggcggtccggcgcagagcagacgcagtatctaccggcgcctcctcttggggagcggtatcctctgaaatgggtgtttctccctcatcaggcggcgccgtattctcaacagaggcggaagattccacagcctgctcttcagcggccggagcctccgcagagtcctcattctcgccatgtacgggatcttccacaggcgccgcctttttccgccggggggcccgcttggtcttggagggagccggctccacagcagtttcggaaaccatctccgctggggtgccatctgcaccttcagcagacaaattggaaggagtctcttcctcaccgtcgccatcctcaccggccgccgatccggcaggctcatccgaatcggaaggggcgccagaggccgtgccgtcatcctcgggggcagcctcatcagacgcctccgtttccataaactcaaggggagggtcagagccttccaaagtggcgtcgccatcaggctgatctgtagaggcgctgtcattggtctgatccatagaggccagcagcgcactcaaatcgtcactgtcaggcggcgccgccgcatcagccggggggccagcggaagaaatggtaccgtccgcgggggcggtgttttcaggaacaggagtttcctgctccagcaatacttttttcttggttgccataaaattaacctcctatgttttgtattaagaaaggatcgagtccttatctgtcgtgatgatgccattcggagcctctgcggttggaacggctgcggtctgcttggtgccggtagatgtgctggccgctttcggctttttcttcactggctttttaggcgcgggggcctgcggctttggctgtgccgcagagggcttcgattgctcctgttccagcctgcgccattcggggatgtgggcggatgccttgcaggaacggagcttggatgcctccggatgtttggaatagtccattttgtctaccttgagaactttttgcccccggatgatgaccagcgcctgcttgataggcagccgcagaacttcgtccggggtgaggacaggacgcttgccgacaccagaggtttcccggtattccggcgtgtagttggagatacgccaggtacccagctgcttggatttgctggataccgacacagaagccagtcccgtgcgggaagaaataaactctgccgtcaattcatctgtgcagcccaggaacaactgcgcgtcgcagttgcccagaatttcctgccagagattgagaggataccgattctgcaagcccgccaagttctgaaacacacagctcatagagatatttcttgaacgaatgacgcttaaccggcgggagaggtctggaatggtgccgcaggctgttaattcttcacccaggacatgcaccggtaccggcagtttgcctccttcgcagttcttgtctgcataccgcaccagcttgatgaagcagaaggacaggaacaggcttgccagaaagtcaaaggtgctatcctggtcgctggtaacaaggaagtaggcgcaccgctcctggccgggcagctccaagtcaatttcatcccgggtggtgatcttcttaatcagctccgactggaacacctgcagacgggagccgaggccgatgatgacgccgctgcggactgtatcgctggcctgcttatacaagctgtatggcgctttggccggatgggtgggcggcaagttctcaaacaggctgtccaaatcggactcgccgcttaaagtcagcagccggtacacctctccgatattgcggttttgttcagcataactctggtccacatagaggacgagggctttcagcaagttcatctcacaggaatcccagaaatggtcgcccttgccgttgttgatggtgttcttaatgatgacatctacaaaaagctgcgccatcagttcctgcccctccacttcggaaaggcagttccaactgtccgagttttccggattgactaaattgaacaccttgacacagtacccctgatcccgcagatactcgctggatttttcgtagagctcgcttttcggatctgaaatgatcagggattctccgcggaccgccgcctgaaggatgcgattcacgcaaaaggaccgggttttcatgctgccgctggagccatacacagccagattgccgttgatatggggattttcaggaatacagacagccttgttgtccagcattcccagtacaacgcctttatgcttgcgcaggtcaggcaccagatccaacacaccggccatctccttgcggctcatccagccggaggtaccgtaggtgcccttggccgagtaaatgaaattccggtcagaatcatattctccggtatcgctgtagcccatgcgcatgaccatgagcagcagaattgccaacaggccgatgcaaatcaggacaccgtacactccgtagggcggacgaaacacggaggccagacaggtaaaaaaatcgggcgatgccatcgccggagaagttccgtctccgggaatgccgccgccctgtttccacgccgcgtaattgccaaacagctgtgccaggaaaccacctgcgtataggatcgcaaatacggcggccggcgctgctgccaggcctatgatcagtttctttttgtttatgggaacaacctcccctcgaattttgtaaagtcaatggtttgcaggtgtacccggtcaccgcaatagtggcgcagcacatctgcttgaaaatcaaagcagatcagcgtaccggggcgttccatcagttcgagggcggtgttgaagcgcacgatccggggcagatcgcagaagtaaccgaatagcaccggcgttccatccggctctgcggcatcctgctccatggcactgccgggattgccggcggagaggccctgtgacagaatgcggtcaagttccgcggttttcacagggtcacacagtaacgccagtatcacctctccctgatggtcattggttaggaaataaaagtggtcgtagctgccgtccagcatgaagtagtcatgcttggccccgccggtactggtgagtatctggtaggccagatccatgctgtcccccaataccagtccatgtacctgctcgacacggtactgctgggccagacgctgctggcatagaatgttccagaggagcgtttttacccgcagttcggatttgtagcgccacttcatcagagcgcccccgctattgtaggtcacaaagatgccggtgggggccagcagcacccctgcgaagcgggagcttcgaatctgggtggcatcagcccccaattccttgacttcgcgtgaactgtaaaacacaggatatgttacagcttcgccgccaaaaccggtctgggcaaagaccttcggcttttcatccgggtagagcagtaccccggcattgcctatagtgatataggtttccgcgaggcggtggagccgaaacctccggtttgcttcgcttttgagccggttggtttctgcgtctcctgtaaggcagaatgtaaaacgctcgggccatccgtccagcagaactgacttggctttgatccccagccgatagccccggagccggtcccggtagtaggtgcgcagcagtccggcctttttgagcgcagtcacgaccgcctccaagtagtaaggactggcgggaaggcggttgagctggctggtggggaactctcccgaaatagcggtcagcgataaaagccggaacggaagcgtatccggctgtggaaaatagttggtgcttttcccaagtagtcacctcccttgaaagcacaggatttttaccgtaatgactgaggacttcggtaaaaacggcccttcccatgagtgaaaaaagcccgaaaaaacgggcgtttcagccgcttcgctgaatgtcgggccggagaaggcctcaaatggtcaaaaatccgagatggattttagactcgttttatgctctgtcagccattgcggaaaacgctgcttctccatgatatagatttttgtgcaatcctggtcacccagttcagccgtgttataggcgtcgcacaacaggcccgtatcatcagccatcacaaaggaagagagaagatccagtaattgcttttccgataaattatcgtaatcgcgtatccgcctgtcgggaagtgcccggtcatagacctgggcgaaacagacaacgcaatcgcggtaatacggaagtgggtgttctcttgcgtattgatcaaggacaaaatagagcgggtccaacaggaactcatcgctttgccgctgtttgcgctttggcagcaaacagggcagcgtcacctccagcaccctgtcctcgcagttgacagtgatgccgtgcgttgcaccggcggatttgagatagtcacctttgcggatggttgtgctggaataaatcagatgccgcagccggcaggcaatccgctctgcccgtaaagcggcatctatggaaagtgtttcatagttgtcggggtaacgctggatgtcagtggtgtccagcgcgtacagcgcattactcagacgggatatatcgtcgagaatgcttccaatgcggtgggatattagttttcgatccaatcatgtgcctcctgctttcttgaaataatttgtccggccttcctcgtctacagtacaaaatccggatatgcccggacagtcgatttgggcgatttgcgccggagtatcgaccagcatgatacggcggcttccccctttgttgccccgcagagcatggcagacaagtgcctcctgcccggcggcaatataagcaatctcatataattcaccgtcggcaaaaaacacgagtttaacgggaaaatcagccggagcgtggtaatctacctgccggatgaagtccagcaggacccacactgcccggacaagcgcatggtcagtttttggtgtttgccctgccaggaaataaccaccgccgtctgtttgaaaaatgcggccctgcctctccaaatgagagagcagggcctttgcagtatcttctttgccagggtgaaaacaaagaagctggtgttcacagaggccggggtacatcgtcacgatccgtagcaagtccgtagcctcgttcccatagatttcagccctggtcttcatggggctcacctcctttattaaaggcgccaatcagacgccttcaaagcgcattgttaaataggaattgtggaaagacgccattagagcgtcaatccggcgtttttcgagaatagtaggaaaaaaaggcgtcttataggcgtattggaactgtcaatgatgcgttttccggagattacagcaatcctctttattgggatttacaaaatccctccagaattgatagtgttccgttacatcttcacagattgtcttctgcggaatatggattttttccacgatccgctgcttttctttcaaaggaagatgatagtagcctccctgccgcacggtatatttagagaaatcaacaccccgaaaccactgcctgatccacgaattgacgcgcagaaattcaaccacacaccgctcaattcccaaatcattcagcttgtcgaaatccatgtattcctcaacgatggggcttaatcggattgccacatcatacccttccgcttgcagagcctgaattgcgcggatacgctggctgggaggactggccttttcaaattgggcggtttgtgtatcgtccagacaggtcacggtaatttgaatatgggccagttccttgtccaagatctctaaatactccggggcagcgggaagtgcagacttcgtgacgatgagatagcttaccctgcacagattcatctcctggatggtctggtaggtagtgcggtagtgaagttcacagggctgaaaacagtctgtcatgcctccaagcctgatgatgctgccggatgggagactgcggattttccgccggaccttttcaatatctgcaacacgaggatgcgccgaatcccataatccacgaaaatgaagcaatgaacgggcatagcagtagttacagttgtgttgacagccgcaaccgtaagtatctaaacgggtgttatatttgcatttgtcgccttcattgcctccaacttgcttaaagaaactcttaaactcgctttatatcacctctaaattcattgtttgattactttattgtcggatacattggactcacctcatataaaattctaaatggttgcggaggacggtactgccccgccgtctgttggtaaagcatccaaccatgttctttacactactccgcgcaataaagggaggcgcttccgcacctcccagagaaaatgccttttaagcggaatcagcttgttcttggcgcttgcgctccaaaagctcccgcagctccctgcggtctgtggttatgagatccttttccaatggactggccttgaactccaccatgatattgttgttattggtagagatcagaccgctgccgcgctcaaagtgtgtgacctccatcgtttctgcgtcagagagatggagggtttcctggacacgctccgcttcgtcatcctccaggttgagaatgatcttagtcttgctgttgttgatgatgcctttcccgaaacggccttcgtccagattgaaaaagtcgttaaggtcctggctggcgcagatcgctgatccaccgaagccgcgaatcgtcttgaaaatttccaaaacgaaatcaccggccagccgggtgccggtggctccggcgccggaaagaagctgccagcactcgtcaataaaaatggctttttcctcggtgcggtcagctttggcgcggtcccaaacgaaatcaagggccacgaacatccccacagtcagcaaatcaccagtaagcgaggaaatatccagtacggtgtacttattatccagccgcacattggtctgcttgttaaaggtactggcggagccattcaccagacggttgaggatatgggccatgcgagtggtttccggggcggccttcaaaatctcatacaagtcgcccagcaccggcatctcccggtagcagcccggattggccgggtcttccaatgaggcgttgtcatgggtgatacctttggaattgtaggtgcggatcagagcctcatccaacagctgtcgttcctcgtgagacatatcagggatcaacagactgaagaatatgtggagttgctggattttggcggccagttcggagagctggattcccggtccgtccagaagctcgctgacagaccgatccaccttgcggatctccatcacattgatgcagtgcgggctggccggggaaatctggataaactccccgcctacattggcacaggcacggtggaattcgtgccctttcagcggcgcaatgatgaaaacgggaatgtttttccgcctcattcttaacgccatgagctgcatcgtaaaggtcttgcctgcgccgctggtacccaggatcgccatattggcgttcttgtaaatcgcagagttgaaaatatccacgatgatgagggaactgttatatttgttgacccccagaaggattccgttgtcgtcgcacatctcaaacgaagtgaacggatagcagctggccgcgcctccagtcaacaggttgcgcttaccacgctcgaacagtcccttttccatggaaaccagcgggagggcagaacaaaatgcctgctcctcccgaaaatggcaggtgcagacatccatatcctgcgaaagcaggagcttttttatttcgctggccttccactccagatcctccacagaaggggcggtcacagtaatcaacaggttgagataatagaaatcctcattgttcgcaagcccctccttcagaaaatagccgctccgaatagcgccgtctatatcatcgaagtccgtgttcgtgtcgctggcatccttgatttttgaccggttgatgcggagctgctggccgacccgctgaataatgcgctctttgggttgacgcgaaagaaacatatcgaggtcaataccatcaccggcattgacgattaaactcagccagcccgcgggcacctgggttttgtaaccatctgatgggacgagcaaataggtatagtacagcccgtctatacagagataccgtccatgggtgaagtcgatgcttttgggagcagcaaattcagccgccgggatgcggtcaatctcaccctcccgccccttgtcgagatactgcgtcacaacttcctgcacccgcaccgacagaggcttgaccgcactttcatttcggcacaataaattatagaaaacatctacggtaaattcgtcctcgttttcgtggacaacgacctcgttgccgcattgacgcaggtaattggatgccgtgtggacagcactttggagagattgaattgcctcatcttcctgttcggagcgccgtgtgttgttccaaggctcatactcaaaaatcaaaaagaagcgtcgtgtaaccgcctcatgggagccgacctgttgaacaaaatccaaatagtcctcttgcatcaagcggcactgttcattgtcctcctgcgccatttcacggcgtactgtgtccaggtggcggttgatgtcggcacgccgggtaagcactttgatctgcaatttaacaggactgatttttaggtatgagacgaaagagtagataatatttctctgttcccgtgcgctccgcagcatgaagttgatggggaccacctcaaccaccttgacaaatcggtggtctttcgtgtagataatgccgttggcgatcttctcaatgggcagatagtctgccaccggattgacgcagggaggcttatcctccttgatatgggcggggcgtttaggcattcgctctttttcaggccgcttctttgctttctttttcgccttattggccttgacaggccgttccttcctggtgtttttcttgggccggagcttttcgcggatctcatatccacggacttcatcaaactcagctgggaaatctgcttcaccagaccgccggtgcttcgacgccttgggcgttctctcctttggaggcttctgtttgagatgcttgccgactttttcacagggctgttcaccgtcaccgccgacaacgcggcgattccgcaggtatttcagaaaagtgaccagaaactgcgataggctttctcctgaaatgccaatgagggcaaccaatgccaccgggagcgcagtcaggcataaagcaataatgcgggcagtcaatccaaatggaaggaacaaaaaaaccggcgtcccgatggcaaatgccaggatgccggcttcaatcacattccgcgcacggaacataccgccaaaaaaagtgcctgtttctataaagttcggcggtatgatataaatatcatggtcattcttgttgctcatgtattacctcgtttctgatgccggggtgcgatacagtcagccaataatccagaaaggaccgcctgctgccgcacggcggcttgcttcgtttaagatgatggataaatcccagagttgttcactgcgcttataactggccgggtctgccaccatgatctgaccatccttcacgccgcgaagaacgatgaaatggccggatgaagtgaaatgcccctcggacataattgccacaaccagcttgccgtcagcaagagcgtccagaatccgctggggctcggaagtcgtgcagccggataccggaagcccccattcctctgcagcagcgggaatcaatgcgtgataagagccgctgcttttgcaccaatagccattatcatatgaccactttgccatttccaccgggtccaccatatcgtccgtgagggaggaaaccacgattgccatggcggtggggccgcacccatagccaccaatgttatcggtgccatagggttgactggcatagcgttcatccaactgattgtaataaacaaccggggtcccgccgtcggtaaaggtcacatctccaagggaggggatgctgttgccggtccattcaaccagattttgcagaagtccgtcaccaagaaacaaactgaggttggaggcataatcagcggccagctccttttgttcatcggtaagagcaaagacagtatcagcaagatatgactcaccattgtaacggatggtgtaaactatccaagtttccgtagttgtgatttcttccccggtttccgggtcctcagccgtgacctcacggctttcctgtacgctggtataggagtaaagatgttctttatgctctcgcagggcagaggccaggccatccagtgaaatgctctcaaagtcttcatcccgggcagcacaatactgcgagatgatgaggttggcgttgtagacagggccggaggaatagggatttttgatctccatctggtcagccccagaagaagcaaaatcctcctcgatgcgggcgatcacatcatccagggcctcacccaagatggcgttgatggtaaaagtgatgtcattggcgttttccacgatagcagtttcgctgttgaggataggcgtatcaggatcagctggtgaaaaggcattgaccagcccgccaaaaatcaagccgggcagcatcaagaggaaaaggacaggcagcaaaagcagaatcgcaatgatagcaatgattttgccgatgtgctttcggccggcccagacggccccagccacagccccatagtggccgccggcggcagcaccttttgcggctccagagatggccttgccagctttgatagcgcctttgaccgtatgtgcggcagaggtcgcagcatctactgtttcggcggagctgtttttttgttcttcagccattatagtttgtcctttcttttgggagtaggcggcagtttcttcacgatggattcgtgataggcaatcgagccgtccggtgccatatagggagatttttcaaccgcatccgcagcatactgcttataccaggcggtaccatctacggcgtgaacggttgtgtactggccttccggcgccacatactggtctgcatgatacataccaaaagcgatgccttctggatgttccggagtgacttctgtgccggtaatgcggccaccgccgatctccacattctgataagtgggaatattctcggccccgggctccaatgccgcatgacccatgtaggaatgcagagcgtctacagctttatccccggtcatagttcccatctgggtgatactcccggtagcaaccgatcctatgacattgttggcaaaattgcctcccttgcttacggatgaagcgtagatatgtccgccgatgccgcctgcagcaccgccgaccaacccgcttaacccggagggtttggcatctggtggcgttgtagctgttttgaccgcattgttggtaacattccttttaatcacaccagccaaaccgccgctggcaaaaccagcgccgaatccagcgccgccttttccgccaccgcttgcattgacatgggaggaatggctgctgcggccgcccgcaaagtgattgctggcaaagctcttaaatccgctgaatcctctggccgcaatcatagcctccgccagcatactgccgccggtatggccgacattgacgcccagactcgccataaaagaatcgatcttctgtgatactttaaggaatccgattgcgcacataaaccagatcagcacattccccgaaacggcctccttgcctacggcgtccacttgtgcctgaacttcttcctccgaaatagcgaaagcaggctggcagaacaggcaggagagggctgtgaccatcagcgcaaggaacaaaattttcttgagtcttttcaaaatggccctccttacaaagagagcgggttggagataaacgaaccaaccatgctcgtgaacaggcgcaggcaccaggcgttcatcagcagaagaaaaatctgaccgcccagcatccggcaccaggatttccagatgtttgatgttgtctggcttgcccccatggaaaaggctactggagccgtatagaccagcacgccgagcaatacatatcgctctgccgcttccagcagcaacttcaggtagttccacgccagaatgatgactaatatcagagtgataagggccacagccccattggcgcacaccccgatgatgaccagcatgacagagttgaaatctgcaaaactgagtgccggcagctccgaatccataatccagttgtacggtgtgccgccgatggtcaggatcatgctgacaatctcattggagaagaacgccaaaagaataaaaatgacggatcggatgctcaatttgagcgggtcttccgcttcaataccggctcccaggccaaagttcttgaacagctgccacacccagttgaggagaatgataccgatgcccagtgcgacaaaaacgctgtacatcgtttcggctgcgggaaagtagcgcagaaataccgccatatcgcagcccagtgcccccaaaaccgaggtggttatcaagtcaaggcccgccatgacctgctctgcaatccattcaacaatgccgtccagaatacccataggtcatgcctcctttcgtcgggtatcaatgtgatgccgatcaacctgcccactgaccaccctcaaagaaggggacgatataggacatgataaagcccagactgtttaagatggcccaggtgataacaattcgtttgagccaagctctgctttcatccaccgttttaccagaacgggagaaattcatgagcagcaatgctaccgaagcggtcacaatggccgcaatcgtggagatagcgaggatctgcgtgtagacatcctgcatgatttctgtggcctttgtccaaacatcggttgcggcaaaggccggctggctgaacatcaatgagacggtgggacacagaaacgccatataagcgattctgccaatggaaaaacggcgcggagggctggtatcgccgtttcgcttttggtgaggaatcttgcgttttttcaattttcggacctccaatccaaatgtaatatgcgggactcaaacaaaagaggagcccgcagctcttgtaatagatgcgggctccctccccaatcggccgattattagggcagcaaaaaagcaccttgaaaaaggtgccgttcactgcctgcattcagttttgggtgcaagtttgagcatattcagtttagcacaccaggatttacggctcaagggcaggaatgcgccaatttcattcccgtattctgccaattatttgcccttggccttttcatctggttttggcgctggaaagaactgttccagcatatccaaactgtctttggaggtgtacccccatagtacggaactgagtgcgtcaatggcttccctgcgcctgcggtagtaagtacggaatgagatgtcccggatatgcggacgcaaattctcgatgatctcctccacatttttgagttgctgcggggagaggaaggagtagtaaagcagccagtaataggcctcgccgttcttgtggcgggtacgaagcaattcgactgctgaatccaaaagtttcagcatcttgtggctgcgctcaatgcacttggcatggtgttcaatatcgctcccattcagatcggcgccggccagatagatggaatccagaaattcctcgatggatgtgccgtattcgatctcaaacttggaccgcacatgctggacagaaatctccaggctccacaccacatcgcggtattttttcaacagtttccatgtatcatggtacagcgggttttctgcgacatctttttcaacaaattttttcatggtaagacctccttgttcaattctccgcgatgggagagagtgtaagttcaaaagtggtgacctgtctgttcccgcacagaatagacaggccaaaacagagcgttgactgttcccgcacgcggggtagtaaatcttcccggcagtcacccgataagggatataacttatagcgggagagggggcaaccaaagcacgaaatcccttgtgccatcaggatttgagccatcttttggatgataatttcaatgtgcgattttgaaacgctattgagttcgtttgaaacgataacctcatgctctatacttggtgtgttttggctggagcctgattcatcggggagttccaaacggatgttgagcgtcatagcgacctcctctttgtccaccataacatccgatatttcaaacatggtggacaggtaatttttcaaatagaccacgctgccgtgtcggcccgggaaggacataagggagatatagtccagcgcggccagctttttgaggacgcggccgactgtcgcccgggacaacccccagcggacagccagttcagtgtaggcaacaagaggattgccggtgccgttgcggaaatagactactggccccaggtctgacccctgtacctgattatcgttgtagacggctgaaacccagaggtccagaataatatccatttcggagcatcggcttgtgctgatgagatctgtgacaacggaaacgggtagaaagaaaaagccggtatccttttggcagggagcattatattcaagcaccgtgttatgccgcgcccagtcgcaaattttatagcggatcacattgccgcgatccagtgtctgaaaagtgataaagtgctgtttctgcagttgttccagcactgtcaacgcctggcattgaaaccgtgtgcgaaaccattgggacacttccttgagtgtgcagacccattcgcccggatagatggtatagctaataccatctatccggcggtatgaagtgcggaagtttgcgtagctgcaaagcacggtaaaataaaaaagaccagagcctccgcttgcgcgaatgctccggtctgccatcagccgatggacgaattgccgataaatccggcatcgtgggtaatccacgacctgtttgatttgcaattgatattctggcatggtgtactcctttttatatataaggtatgaaattcggtatcagggttaaaaaatcgttgacttgaacatctacaaagcttatgctatacttgtttctgtatggatctgcttgaaataatatgtagagtttatacagaccttattacagccgagcaattttatattgtggtcgcttgtaggccgatgaagcctattgctgtgccaatttcaagccgattttgtgccaatacaactttctacaacttttctacaacttttctacaacttttgcctcaaaccagacggcacaggaggacatcctatggaatccaaaaagttagaaaaaccatgtgagaatgccacttttcaagctctgcaaggcgtgatgaaaccggatgaagagaccggaggggtgttcccgaccatgaagccggttcctgcttccggaagctatgcctgtgagacggcaagctatgtctggacggatgaaaccagagaggagagcttccggaatgacggagctttcaggcaggtagcggtacagttctggtatccggcagcggagaatgaggagaagtttccgctggtagtgttttcacatggagcctttggctatcggatgagcaattattccacctatatggagctggcaagtaacggctatgtggtatgcagtgtggagcatccctatcatgccatattttcagagctggaagacggacagataataatggcggataaaaattttataaacgatgtattccgggtaaatgaagagggaatgccggaagaggaagtctttgcactcaacaggccctggataaaccttcggacggaagatatgaattttgtgctggaccggatagaagaggaatgcgggcgggaaacagcggatttgcctttccggctggcagacattcagcggacagggctgatggggcattccctcggcggtgcggcagcggttaccgtagggcgggaaaggcccggtgtaaaggcggttattgatctggacggaaccatgctgggagaagagctggattatacagacggaaaatatctgatgaatacggaaccttatccggttcccctgctttgcattgataccacaggacattacgtagaaggcctgaagtatggagatcaatatgtgaatcatgtgatacttgctgaagcggaggaggcaaaagaaatccattttgatgatgcggagcatatgaattttacggatctgccgctcttttccccgcctcttgccgggcttctgggaacaggaaagcgtgacgcaagggaatgcatcatgacgatgaaccggttggttttggaatattttgactattacctgaaggaagagggggagctttcccttaaggaggtttactgattattgatatataaaaaaagaacggaactgcttaatcagtgcggtgcgccgggaaggggctgacagggatatatgcgggtaacggtggaaacgattgaccggcagcaggaagaacaggtgctgatacgctgccatgaggtaacggatacggttcgggagatccggcattttattctgtccaggcaggaaagcctggaggggtatgaagccggaaaacagtttcagatccctcttccggagatttattatgccgaggctgtggataaccgcctttttatttatacgaaagagaaggtttatgaagtgaaaatgaagctgtatgctttcgaggaagcatatggaagcaagcagtttttccgatgctcccggacggcggttgtcaatctgatgcggatagattatctgaggccggccctgaatggccgtctttgcgccaggctgcagaacggagaggatattatcatatccagaaaatatgtaaacagcctgcgtgagatattaaaacgcagagaagggagcggaaatgagtaaaagagagtttatagaacacctggtaatcagtttttttgttgtggtcacctgtgtaaacctggttatggcattcctgggaatgcggtatgagccggaaatcagattcggctaccaggcttttctgcttcctgttatctatggagggctgggaattctgccatcggcggtgacttatagcaggaaggagctttccgtcagacagatgctcgtacggaagctgctgcagctgcttctgctggaaggaatcatggtcagcatcgtatttttcatcggaaaaacggattgggaggtactgctgccctttatgtttctgatagtgattatcagtctggcggcggagggagtcttgtggtttgttgccgacaaaaaggcgaaggacatgaacgaggagttaaagcattttcaaaacagaaagacggaaagctgaggggcggccccctgctttccgtttttctcataccggaaccttgaatagcagcattgtggtaccgggatccgattgtgtaaggaaagaacctttacacagcgtctttttttcggtatgataaagaaaattgggggctgcagtccgggaggggcggacaatggcggcggctgaatcggacaaggggtataaaaatgataaaagcaattgtggtagatgatgaaatcctgacgagggagggaatcagcgccaacgttccctgggaaaagctgggatacgaactggcggcggcatgtgcagacggacgggaagcgcaggcctatgtgaaggagcatgaggtggatgtggtgctgacggatatctgcatgccctatatagacggcctgcagttaagtgaatttttgtaccgcgaatatccgcaggttaaaatcattattttcagcggctatgatgaatttgagtatgcgaagcaagccctgaaatatcaggttaccgaatatcttttaaagccggtgacggcatttgagctttcggaggtccttctgcaggtaggggaaaaaatcagcgaacagaagaaaaaggacgagcggatcggaaaaatgagcacgacctatcaccggaaccatctgcttgtccgttccaatgcattgatgagcctggttatgggggataaaacgagagaggaaaacgaccgtgagctggaggatgtgggaattaccctttggggcagcgcctttcgggtagcggtggtggaaatagatgattaccgtgatgccaacagcctggatgacaagcagaagcaggagcgttcactcatggcttttgtcgtttataatgtggcccaggaaatcgtggaaaaacagcatgcgggagaggtattccagggaaaggattatcgtacggtgctgcttcttgaaacgaaccggccggcggagctgggacagcggcttcatgaaattgcaggagaaatcaacagacgtctcctggaaatcatgaatatgaaaaccacaatagggatcggcggctgtgtaaaggaacggggagagctgttccggtcttatgaagaggcgatgacagccctgcagtaccgctatacctatggagaagaatccgtgctgatcctggaggaaatcagtggtacgccggaacgctccgaggcggaggccatcatggaaagaatccttgactgtgtaaaacgcggcgacagggatgggatcaagcagtgtgttgacaagatgaaggaggatatccgcagggcggcatggaaccgggaaagagtcaaccttcagcttcagcagcagctggacgaaacggtggagctgcttcgatcctttcagctggaggaacaggatatcttgtgggagaaggagaggactcttgaaaaaatcataggagcctcgggcctggagcaggcgcttggagtgatggaagagtatttccttaaggtatccggaatgctggatacgggaaggaacgatggcgggaaaaaatacgccctccttgccatggaatacatagaaaagcattacggagaaaacgatctgggtctgagtacggtatgctcttatctgaatatcagcacaagccgtttcagcaccatttttaaaaatatcacgggagagacctttatggaggtgctcaccggtatccggatgcagaaggcaagggagcttttggaaaacacttctttgaaaaactatgaaatcgctgaaaaggtaggattttccgaccctcattatttcagcgctgcctttaaaaaagccatagggaaatcacctacggaatatgcaagggaaaagaggatataaggatgaaggaagaaaaggaaaagccgggaaggaagggaattctgcccttttccagtatccgcaccaccatgctggcggtgttttccactttgatcgtggcaacgctcacttttttctatatcatttccctgaattatacggaacggacgattctgaacaattccatagactataccacccggctcatcggacaggttaacagggatatcgattcttatattgattatatggaaaatatatcctccctggtggcccacagcagcgatgtacagacctatctgatggaaggaaggaattccggggatcccaatctgtaccgccggatcgtcacccagttttccaccgtactggagaccagaacggatatttccaatattgccgtgctttcaggggacggaaaaagcataatcaatgacggaaacgacgtgctgaatgaaaatatcccactctacagtgtggactggtaccgtgaagcggaagaggagggcagcacctgccttacctcatcccatgtgcagaatgtcatcagggataattacaaatgggtgatcaccatgagcagagggctggaaaaccccgacacaggggaaatcatgggagtttttttcattgatctgaattataaggcgctgaaggatctgtgtgaaagaaacaatatcggctcggattatatttatatcatcgatcccaccggaaaaatcatttaccatcccaaacagaagctcatttacagctccctgaaaacagagctggtcgatgaagtgctggaatgtgaagacagctttttcctcacagacgatgagaaaaacagaaggctgtacacgatttccgtatcggataaaaccggctggagcgtggtcggagttaccgatatggcggagctgatgcggggacgctcggaagcccaaaggctgtacattgtcataacagcggcctttcttgtggtgacaatcctgctgtgtgtgattttttcttcggcaatcacacgtccgctggaacggctgaaggattccatgaaagaagcggaaaaaggaaagtttgaaggaatccgggtaaaggaagaaggaaataacgaaattgcgagcctggggaaaacctttaatatcatgattgtccgtatccggcagctgatggagcagaatatctacgagcaggaacagaaacgcctgagtgagctgaaggccctgcagtcccagatcaatccgcattttctgtacaataccctggattccattatctggatggcggagggcgggaaaacaaaagaggtggtgctcatgacctcttccctggccaggctgcttcggcagagcatcagcaatgaggatgagctggtgtccataaaaagggaggttgactatgccaggagttatctgaccatacagaagatgcggtaccaggataaaatggaatttgaaatccatgtggaagaggaaatactggaacagcagatcatcaagctggtgctccagcccgtggtggaaaatgccatataccatggaatcaaatataaggacggaaaggggctcatcaagatcaccggcgtgcaccgcagcggctgcattaacctcactgtatatgataacggtaaagggatggaaccggaggttctggagcatatttttgatcctaaaaccgggcacaaatccaaatccggaataggcatcagcaatgtgcagatgcgtctgcagctgtattacggaaaggaatacgggatttcttataaaagaattcccggcgagggtacggctgccacgataaggatcccgtttgccggaggggaggcggaaatcattgaaaaataacacaggccatgtcctgaaaaacatgataatgtccaataaaaagagaatcctttctgccgccctgcttcttattgccgccgcgttcctgctttcctatgctttcgggagagaggacagggaaaagaaacagctgtccattatttttatatccaagacaatcgatgacagcgatttctggacacagctaatcgacggcgcccgtatggcggcagaggaatacgaagtgaagttctcggtctgcgcgccggagacggaggatgactatgtacggcagaatgaactgatagaacaggccattcttgagaagccggatgctattgtcctcacaccctccagctttaccgaaaccacccctatggcggaaaaaatcgtggaaaacggaatccgcctcttccttctggattccgaaattgacacaaaggtagcggaatgtatgatatccaccgacaacataaaggccggaaggctgcagggcgaattcgtcaagaaaatcctcaggccggattcccggatcgcggtggtggcccatgtaaagaattcctccactgccatggaacgggagcaggggctgcgggaaggactgggcagtgacgcggaaaaaatagcggacgtggttttctgcgattccaactatgataaagcctatcagctgatgctgcagatccttgcggaacaccccgatgtggacgttgtggtaggcctcaacgaatactccgccgtaggcgccgcccgcgctatagtggacaaaggactggcaggaaaaatcagctttgtaggctttgacagctccctggaggaaataaaaatgctggagggcggcattttccggggaatggtaatccagaaccctttcaagatgggctacctcggcgtagaaactgccgtaaaagccctgaacggagaaaaggtgcccgatcagatcgattccggttccgtccttataacaagagaaaacatgtatctggatgaaaaccaggaaatgctttttccttttaaaggagagtaaccgataccccacccttcgccgtcccttttcctttcctccgaaggttatgtcgtgcttcgtcaacacgacaagaatcaacaaagaaaaactatatttttgtggtatttgcagtacgaaaagggtaaaaatttacagaacagtaaatttttaccctttttttataaaaaatcacatgtagttttatttaaggtgtcactataataagaccatcagcaagagaaagaaaagacagattacagttcagacctgtctgaatcgttacgtttaatctgaaaagagaagggatggaaggtgaaaaagtgggggaagtaattctgacgatgaaggatatcgataaatcctttcccggagtccatgctctgaaaaaggtaaacctggaagtacgccggggtgaggttcatgcgctgatgggtgagaacggagccggtaaatccacgcttatgaagattctgaccggcatttatttcaaggacagcggccagatcatatatgaaggcagggaagtggcgtttaccaatcccagggaagcacaggacgcgggaatcgcgattgtgcatcaggagctgaacatgatgcagcagctgactgtggcgcagaacatattcatcggacgggagtatatgaaagggaaaatcatagacgacggaaggatgaatgaggaagcgggaaagctgtttgaaaagctgaacattgaaattgacccttcccaggttatgggggatttgaccgtgggcaagcagcagatgtgcgaaattgccaaggccatttcaagggacgttaaggtattggtgtttgatgagccgacagcggcgctgacggattccgaaatcaatgagttatttaaaatcataagggatctgcggtccaggaacatcggtattatttatatttcccaccgcatggatgaaattaaaatcatcaccgacagagtaacggtcatgcgtgacggcgagtacgtgggaaccttaatcagcaaagactgtaccaaggatgacatcatcaacatgatggtgggccgtacgatttatgaggacccgaaaaccgaaagcagtgttccttcggacgcgccggtggtgctgaaggtagagcatctgcaggcgggaaagatggtacaggatatcagctttgaactgaaaaagggtgaaatcctcggcttttccggccttatgggcgcaggacgtacagaaacggcaagggctattttcggagcggacagaaaagaaagcggagatatttacgtaaacggcaggaaggtggaaatacacagcccgcaggatgcggtggaagccggaatcgggtatctgtcggaggacaggaagcgttacggtgtggtgctggataaaactattgcggagaacaccaccatggcgtctcttgaaaaatttgtaaaaggaatcttcatcaacagaaagagtgaagaggcaacggcccaggattatgtggagcgtctgaataccaaaacaccaacggtgaatacgccgacgctcagcttgtccggagggaaccagcagaaggtggtaattgccaagtggctggtgcgtgactgcgatattcttatttttgatgagcccaccagaggaattgacgtaggggccaagagtgaaatttatcatttgatgaacgaactggccgcttccggaaaatccattatcatgatatcttccgaactgccggaaatcctgcgtatgagcgacaggatcatggttatgtgtgagggaaaaaagacagcggagattccgattgaagaagcgtcgcaggaagtgattatgcaggctgctacggtcggtatgtaaagggggaggaaacaaatggctaaaacaacaaatacggaggggaccgtaaagaaaaaccctcttgcaaaatttgcaaagtccgtgggaacgcagaggctgatagccctgctggctctgattcttatttacgtagtgttcggatttatcaatccggctttccgttcctatgccacactggtaaatatttttgacgcatcctattacataggactgatggctatcggcgttacttttgccatcacttccgatggtattgacctttccatcggtaccgtactcacctgttccgcattgatttccggacagctgattaccaaataccatctgccggtggccctcggccttctggtatgtatcctcatcggcagcctgttcggcctgctgaacggcctgatggtatcttacatgcacctgccgccctttatcgcaacattgggttccatgatgctttccaagggcctgggttctattttcaccaaggcgcagagcgttacctggccgcagtccagccaggcggaaggctggttccgtaatattttcaaaatcaatcagaacggagtgctgatacctaccggatttatccttttaatcatagtggctgttatcgcttccatcgtgctgaataagacacggcccggacgttatatcgtggctctgggcagcaacagtgaagcgacaaggctttccggtgtcaacattgccaaatggcgtactctggcctatattatcagcggcacgctggccggcctggccggtctggcctatgcatccatctactccaccatcctgcccgggggcggcggcggttttgaactggacgccatcgcaggcgtagtgatcggcggaacctccatgagcggcggctacggaacgatttccggtaccctgattggtgtgtttatcatgtccgtgctcaaaaccggccttccttttgtagggctgcagagcaactggcagcaggcggttaccggtgtcgtactggtattcgcagtatttatggatgtcatgaacaggcagaaaaagaaaaaagcctgacagtttcctgtttataatgcctgacattccaaataaaaaagagggatgcgggcttgtaattacaaaaccggcagaaaagttaccggggtataacaaattttaaggagggttttacatgaaaaagaaattactcagtatcgcattgggtgtagccatggtggcgagtatgctcgccggctgcggaaacagcgccggcacatcggctccggcagaatctgcagcgcctgcgcctgcagagtccaaggaagaagctcctgccgcatctgcggatgcagcggaaacaaccgcggacacagcggaggcttccgcagaaataacaggaaagatttatctggtatccaagggcttccagcatcagttctggcaggcagttctccagggcgctaatgaagccgctgaaaaatacggtgtggaaattgatttccagggaccggataccgaatctgatatcgcacaacaggtacagatgctgaacaatgccttcaataacaatccgcctgcaatcggcctggcagccctggataccgaagcgtgtctggataccattaaggaaatccagaaagccggcattccgatcatcggttttgactccggtgtacccggcgctcctgaaggagctattgcagccaatgcggcaaccgacaactatgcggcaggcgagcttgcagcagacgaaacctataaactgattaaggataaagtagcttccgcaaccggtactgtaagaatcggcgttatgaaccaggaagccaactccgaatccatcgtacagcgtggctcaggcttcgttgacaagatgaaaacccttctggaagctgacggcaagaccgtttccgtagaaggacatgacaaatgggcgaacaaggttgacagcgcagacgttattatcgacgttgcagttcccgcttccgtaagtgccgacctgtcttccgtagatgcacagaacctgctgaacaaaccggataccatctgcatttatggttccaaccagttctcaggcgaaggcctcatcaacggcgatgccaatatcggcaagctgggcaaagacataatcggcgtagcatttgactccggtgttcttatcaaaaccgctgtaagagacggcaagctggcaggcgctgttacccaggatcctcttcagattggctacaagaccgttgaactgtgtgtgaaagccatcaaaggcgagcccgtaagcgatgttgacacaggctgccagtggtataccgcagaaaacatggacgatcccaagattgctcccaacctttatgattaatgaattaacataagcttaacttattccgaacataataaatattgattttacttatggtatataataatatataatcattaagtaaaagacgtagaaagcgggttttttacaatgggtttgtaaaagcccgctttttattgacaaaaacagaaaacaggccaaaaggcggttttcctgtgtgtgcgcccggcggacgatattatccatcgcctgcgggagcggaatagttaggaggaataaagaaatggtaaaagcagttgtaggcgctaactggggtgacgaaggaaaaggcaagatcacggatatgctggccaaagaggcagatatcatcatccgtttccagggtggtgcaaatgcggggcatacgattgtgaacgattacggaaaatttgcccttcacacacttccttccggtgttttttacggacataccacaagcattatcggcaacggcgtcgcattgaatattccggtgcttatcaaggaaatcagctccattacggaaaaaaatgtgcccatgcctaaaatactggtatcagacagggcacaggtagtaatgccttaccatattctgtttgatcaatatgaagaggagcgcctgggaggcaaatccttcggctccaccaaatcgggcatcgcgcctttttattccgataaatatgcaaagatcggctttcaggtttgcgagctgtttgacgaggaagggctgaaaaccaagctggccagtgtatgcgagacaaaaaatgtgcttctggagcatttataccataagccgaagctggatgtggaagagctgtatgctacgatgatggagtatcgggaaatgatagctccttacgtatgcgatacctccgcatatctggatcaggcgatcaaggatggaaaaaatatcctgctggagggccagctgggaaccctgaaggatccggatcacgggatttaccccatggttacttcctcctccacactggctgcttacggcgctatcggcgcgggaatccctccttatgaaattaagcaggttattacagtctgcaaggcatattcctccgctgtcggcgcgggagcttttgtatcggaaatcttcggcgaagaagcggatgaattaagacgccgcggcggcgatggcggcgaatacggagcgacaacgggacgtccccgccgtatgggctggtttgactgtgtggcatccagatatggctgccgcctccagggaaccacggatgtggcctttaccgtactggacgtgctgggctatcttgatgagatcccggtatgcgtgggctacgatgtggacggggaggtttccacggatttccctgtgacatggaagctggaaaaggcaaaaccggttctggaaaccctgcccggctggaaatgtgatatccggggaatcaaaaactatgaggaactgccggaaaactgccggaattatattgaatttgtggagaagcacatcggctatcccattaccatggtgagcaacggcccgggaagagatgatattatttacagaaagagtacgcttgaaaaataatcggcggtgttcagccatgaagaatgaaagcatcgggaaacgacagtcatgaagcagtcctgccggcggcaggaacagccggaagggagcagcggtggttcagaatctggaatattataaggttttttatcatgtggcccgctgcggttccctgacgctggcggcccaggagctttccatcagccagcccgccgtgagccagtccgtcaagcttctggaaacatcagtgggggtaaagctttttgtacgcagcgccaagggagtgaagctgaccaaagagggagaacttctctattcctatgtggccgggggctatgagcagattgaaatgggagaaaagaagctgaagcagatgatggatctggagctgggagaaatccgcatcggggcttcagatatgacccttcgcttttatctcctcccttatctggaacgttttcatgagctctgcccgggcataaaggttatggtgaccaacgcgccgacgccggaaaccctggtattcctgaaaagcgggaagatcgatttcggcgtggtgagcacccctttttccggagagggcgtccacagcgagactgtccgggagatagaagatatttttgtggcggggagacagttcttccagtataaaaataaaacactggatttacatgacctggaaaacctgcctctcattaccctggagaagaataccagcacaagaagctgcatggattcctttctggccgaaaacggcgtgcgcatcaatcccgaatttgaactggcgaccagcgatatgatcgtacagtttgccctgcgcagcctgggcatcggaaatgtagtgagggattttgccgcggaatatctggaaagcggccggctttttgaactgcgttttaacaaaatgatacccaggcgccatttctgtgtggtgacgggaaaagggaacctgctgtccgcggcggcacgcaggctgctggaattaatacagacggaagagtacagaaaggaacaggaatgatacggactattatttttgatatcggaaatgtcctcaccgttttcggctggaagaattttcttcacagcttcggctttccgccggaaatcgaggaacgcgtggggaaggcaacggtggataacccattctggcatgaattcgacaaaggcttcttaagtgatgaagaaatgctggagggctttatccgcaatgacccttccgtggaaaaggagctcagggaaatctatgtgagcctccatggcatagtgacaaaggcggattatgcgattccctggattcaggctttgaaaaaagccggttatcaggttctggtgctgtccaatttttcagacaaggtgaggcgtgaaaacggcgatgcccttgatttcctggaatatgtggacggagggattctttcctataaggacggggtaataaagccggatcccgctatttacagccttttgctggaacggtatggactgaagccggaagaatgtgtgtttcttgatgatatgcagcccaatctggacgcggcagcccggttcggcatacatacgatacttttccggagctatgaagaggcgcaggaagaattgaaaaagctgggtgtggaagtataaggcacagcctgcagaaagcaattcataaatacgtctaagccgcggcagggataccggggcgttaaggcagctgaaggagattctttcaggaatatagggaaaagcaataaaatacaggagtaacaaaaacggaagcggagaagggatattgccgcttccgttttgttgctagctgctggcaatgcgaatgagttataaaaaagggtgattgcagacaatgtacaaacaagggtataatcttagcagagaaagagtggaaaaacgtacatttatcatagcatatctattttcgagaaaatgtgtctgtatcagagttaaaatagaagaagtgaaaggagtaagaatgaaaaagatattgcccttagggattgttgattttaaaaagctcagggaaaacgatttttattatatagataaaacactttttattaaagagttattagataaaagaagtcaagtaatccactttacccggccaagaagatttggcaaaaccctggaactcagcatgcttaaatatttttttgaatcagtacatgatccggacggatgcagtgacgataatagttccttgtttaaagggttgaaaatcatggatgcaggggaacgttataccaggcatttaggtcagtatccggttatctgtatttccttgaaatcagccagacaacccgattttgagaaggcttttatcatgctgaaaaggcagatcgcagacgaattccgaagacataagtatgtgacagacagtctggaggaaagcgataagctgagatacaatctaattatgaacgaaacggatgaggatgcacagtatctggatgcccttgctttcctttcccgtattctgaatgagtaccataaaagaaaagtgattatccttatggatgagtatgacgtgccactggaaaatgcctattttaaaggattttatgacaaaatgacggattttatccgttccttgtttgaatcggcactgaaaacgaacccaaacctggagtttgcagttataaccggatgcctgcgaatatcaaaggaaagtatttttacagggctgaacaacctggaaataatctctataatggatacaaagtatgcagaatattttggttttacccaggaagaggtagaaagcatgctatcctactatgggatagaagaaaaaaaagaggaagcgaaaaaatggtatgatggatatctcttcggaaacacggaggtgtataatccctggagtgtaataaattatgtcaaagcggcctttgctgatcatggagcatttccgaaaccctattgggcgaatacgtcatccaacagcattgtccgggaactggttgaacgggcggacagcagcgtgaagcaggaaatggaagagctgattgccggaggaaccatagaaaaaccggtgcatgaggacattacttacgacgaggtttataaaacagaagataacctgtggaatttcctgttttttacaggatacctgaaaaagctgtctgaaagatttgacggggagacgatttacctgacactggcactcccgaatacggaggtaaaactgatttaccggaataccattttagactggtttaatcagaatataagaaaaaagatttttctgcgctgtaccgcggtatactgcagagggagactgatgtgctggaacgggaaatatcaaagaatttgatggagacgattagctttttcgattataaggaagattattaccatggatttctggccggcctgctgaaaatgatggatgggtatatcctgaaatcaaaccgggaaagcggattggggaggagtgaccttctcctgctgtctcctgcatatgaaggggttgcggtaattatggaactgaagatcgcggattcctttgcacagttaaatgacagtgcccgtcaggcattatgccagattaaagaaaaaaagtatgatgcggaactgaagcttgagggttaccatacgtttatatattatggcatatccttttacaaaaagttgtgccgggttatagcagaatagcagtaataaagaaggaagatgacaaaaggggagcgccacataaaatataacattctccttcaaacatataaattaaaagataaatttcttgccggctggatatattccagccggtatttttgatttgaaacgaaaattcatgatgattaagaagcctgcagctcgcggattcgttccttcagctgtgacatgattttagaccggcttactccggtatagcctatccggttggcaattttaaacaggtgttccctgaaaagctgtataatatccggctgcgaaatttcaaaaacggtgagaggcggagtggtgcggacaaggagggcacgctgtatatccttcagcataatagtgccgttttcctcggtctgtgtattgagcggaataaaatgataattgtcattagacttcaggatctcaaggatgtttttcaggtgtaatacgtaagtttccggcgtgtaataaagcggcatgtcgttatcgccgtatgacaggataatagggactttgccgtctcggacctcctgtgccccggcaagataggcgatatcaataaattcaaaattctcccggttttcctcgatgagatccaattcctgcagatacatgcctcccagctttttcaggttaggctgctgtattttttccatacagtaggtcattagttccggcggcgctgtttctgcggacaaggaggtcaccatctggatccgtgccccattcagggacagaaattgtgtaaaacactgcatcagctgttccggcctggtataaatacgctgcatgggccggcagagggacagatattcctggaactgtaccatgtaggattcggtaagcctgctgtctgcggtcaaaatagtagctgtacagtctctctgtgaagcgactgagtcggacgtcatggcgatttcaccagggataaccaaaagtgtacggcgatggacattgtcccgcagccgggggtaaaaataagcatccacctggcctgtcatgtacagcggcgtccaccggatcagtgattcaaaggccatgtcggcagagacggcaggaggagcgatttgacaaaaccggaagcccctctgcaaaagagtaagaccccagagctgaagattattgtgaaaatcaaaatcctcagaaatccaatcgtccgattcatccgaatagaggaaaaccgtacagggtttttccatggacagcaaatgctggtaaacagcccgggccgcagcacgtttcccttcttttccatagtaggccatgttgtctgctttcaggtcgcaggattctattttctgactggtgtctacttcccctaccaaaaaagtttcaaaggtacgcataaaacgtccgacttcatcggcatctccgcagagccagtaataaagaatttcggaaagctgctccgtcttcatggtgagcgccagttttattcccagcattccggaaagagcctgacgctggtattccgtggtacacttcctggcgaaataggaagacatgactttaatatgctcacgattatggggaacgccccgggtaccggtacgcagacggctgataagggatggatcaacctgcagctcatgggcaagcatccggtttgaggtttgtgtcagattcaataaaaatatcagtttctcataaaattgcatggaatacttcccccttttcttttagtatacacaaggtatgaaaatatacaagatattagtgtcatttttaatgacaaaaatatggcattgccaaatgttaaagacagattgattaattttttaattatagataatatattaataaatatttatattactgtaatgattatattaatggctaagcatatttttttgaaagtaatttttcaattgggcgtaaggatttctattacgcttaattggtgtcatttttattgctaaaaataggttgttaatagaaattagattcatctgctcattacctgactggtaaattgaatgaagggtgtccgtatgtaacggcagaaaaagcagacggcagacgttttaactgccgcctgttttgccgctctttatctaaacaggaggctgtttttatgaatcgaaaacgaaaaaagatcacactgtcaggtataatcggcggcctgttatgtctgctgtttatacctgtaattgttattaatctggtattgattatcaacagctacataaatccggaggaacttcccggtgtgcttggaataaagcctgccattgtcctgtccggctccatggaaccggctattcagacaggtgacttggtttttatccataagacggaaacagaaaagctccgggtgggggatgtgatttgttatctggattccggagcggcagtcacccaccgtattatagcagtgacagacggagaagacggtcttccccgatatataaccaaaggggatgccaatgacgcggaggatcatctcagtgtagctgctgatcagatacagggtatttggaaaggcggccgtatttccggccttggcaatgcgctgttgttcatgcagacgacaacgggcatgcttctttttattgttttgcctttgctgcttttttttatctgggatattggaatccgatatcattcggataaaaaggaggctgtcagcagagcagaactggaggcggaactgtcggcgctgaaagccgaaaaagagaatgggaagactgcagagcagtaaatccaaatgtatgcactgcctatggatgcgggcacagagcggaaatgggctgtacagtaccaggtgagaaaggtgtgcctgggatagagtgccgcaggcacatgggaaccgtgtctgtgcagacagatcgggttcccgaaaaaacagaaagtgaggacgatggctatgaagaaaaaatcctatacagcgcgtcttggcgccctggcactggcgcttaccatggtaacaacctgtctgacaggcgggactatggcgaagtatgttactacggtatcggcaactgggtcggcaacggtggcgaaatttgatgtggaaattaaggggaatgatactaaattccaaaataacacaaagataccgaatctgtttactactggatggaatccgccggtgggagatggtgtaaaacctgagatgcttgctccgggagtctatggatattttgatattgttgtaacaaatagtagtgatgttttaattaaggttagtgatgtgtcgattactcctgaaacaaaaggcgtatcagatggaaagaaaatcagaatgaaatatgctatatcagatgcaactagtgttgataaaccgagcgtttttgatttggagattgagaatttagggataaaaataaaagataacttaggaaatattggttgggaaacagataattcaaaaacagtacgtgtttggtggacatgggaaaatggcgatgtaaaaggtgacgaagaggataccgcaatcggtacttacggcgataatgcaccaacatatgcactgactattgatatcactgctgaacaggttatttcaactcctacaccctaatctccataaagtttccgcccctcctgtgccggggggcggatccgtcgatggtgttcagcccgcggaaaaagggacggattccgcccctttttccataggctgaacctattgcttttcaaaggaggatcgccatgatgaaacaacagaattacacctccctggctgagaacaaagagagaaaaagctttcccggtctgccgctgctcctgctccttctgctgttagcgctggtaacatccggcatcgtgggttttatactggggaataattcagaacccccttcgcttggccagattatagataccattctgctgacaccggatttaccttctgccggggaaaccatacatcttaccggaagggtattttataccgacggaacaccggccgcctcacgcagcctggaacttcacagtgatccgctgcgcacagtaaccaattccgatggcgggttcctgttttccaacgtgcctgaaggacagcataccatttatgtacggaatagtgatggtacggccgccgcacagaaggaacttgaaatcgtgcgtgacagcagtgcagatacagccgtatctgttgatatgaaaacaggcggcggatatataattgagctttccattgatgtaagaatactggaaattgaaattgaactggataacgataccctttttatcaacccggatcggatttgctatgaggacagggacggtatggtgacaacacctgcgggtacggcctccatacgggacggcgttattgttacgcccggaggaaacgtatatcttccggacggaaatgttgtattacccggagggggagcgaacgatcctacctatatcattcttacggatgatacggttcttaccaaccggcaattttcggcaggggggattaatgtatctgcggatggcatggtgacgctgccggatggtacggcaatccacccgggcggcgttattctgacaccggacggtgaaacagaaatgacggggcagggcggagtaattgtcggcgatggtatcgtaacgcctatcgggagcggcgaaggccgaaatgatgccttttccgctggaatggataggaaaccggaaccgtcagccccttctttatccggtgaatcagacaatccggtaagaccggatatacctgttgttccggctgaatcaacagaaagcaatacgggacaaaacgaatcttctcccatacccggcacttctgtaaatcccgacgcttccggagtgggaggagaagaggagaatcccggcggacaggaaggcagtggcgacggaggaggaagtattcctgaagattccgataaaggaagccttcatgtggaaggagaacaaaaagacgggggttatatatcctgggaacagaatagtgttattgatcttttttataatccacaaaccggggaaaatgagaaaatcgcgcccggatccagcggcttttaccggtttcgattaaaaaataccagaaaagaaaaactgacacttatattatacctgaaagaagcagcaggttcttcctatcttcctctgaagtttacattgaaaccgctgggactggaagaaaatgcgaagtcaggttctttagcggagggaaatactcttacattgcatgcagtaatggaagaaggagaggaagccgtttatcagctggattgggaatggccctttgaaagcgggatggatgagacggataccgcagcgggaaaacagggaggctcgtatacgctgaatttaagcattcatgcggaagggggaggctgacctatgaagatattcggaaagcttctgaaggcagcggcaaagcttttttccatagtgcttatggcagcaatccttttgcagcttgcaggttcagtttttgggggacgtgagcttcctgccctgtttggttactcctgcctggcggttctttcaggcagtatggaacctgcggtctctgcaggagatttgattgtgattcaccgccaaacagactataaggaaggggatattatcacattctcagaagacagtttttatactacccatagaatcattgcatcggatgccggaggttatcgtacaaaaggagatgccaataatatacaggatgcggctccggtgcggtcggaacaggtggcgggaaaggtgaaatggattattccgaaggccggaaaactgtttctcgctgttcggtcaccattggctgcagcctgtatttttttgctgggagctgcagcatggttactatcagatcaaaagaaaacgggggagaaaggagcgggtgaatgaaaaaacagctgactatgcggcgggtaatctgttatctgctttatttcctttttgtctgtatgctggtattcggaataacgaatgcccgttactacatcacaggtgccggtaccggttcggcacaggcagcggcggtagccatgaattctacaattgatcttacaaaggaattaaatgaactgaagcccggaaatacaaaaacaattacatttgcagtcaataattataaggaagaaggtaagatcagtgaagtggcccaggattattccattactgttacaacgacggggaatcttcctttgcagtatgaattgtcattagaggacgagacacaaaaagacagtgtgatcactggaaattatgtgaagtgggaaactccgtcacagggatcgttttctacgatttggaatggaggatatctaccccatagtgtggaagaggaacatacatatgtactggctgtgacctggcctggagatgagaatcaggatagctatgcggatgaaattgatctgataaccttgacagttgatgcaaaacaggcgggagcaaaaccggactgacgggtgaggggaaagaatgaagaaaagaaatgtgagaaggaagaaaagattgcccggaatcgctgtactgctgatattgacagagacagcagttctgatattcggaggatataccgcggcgcgttatgtattgcagaagacagaaaagacggtagctgaagcatcggaattttattttaccagtgatttgctcagagaaacgccggaagaattgtcggaagaattgccgaactattatgtcgatccacaaaataaagactttcagattgcactttataactcggtggattctctgagagtgacatcagcagatatcgaatatgaggtagcggtccaaaacggtaaggcagaaaaagtaaaggggactataaggggaggaaaggcaaatacggagaacatcagcattactcctgatgaaggtgagaagagcgtcactgtaaccgttaaaacaacgcagccgtattccaaaatactttcagccacctttacattagcattaggcaatcaatattccatagaagatgaagccggaaatatagcggctgtgcttaccatgaattgtacggatgattcaaaagctgtaaagctgtctctgcccgatggcataataccggataatacggataaaagggtaagcaagacagcggacggatatactttccagtcttccggtcatgagatttattccttggtattgctgaaatcagacagtgggaaaaatgtgagcaaaacttctgaatcttttgcggactctataaatataaacggttaattgatataaaaaatatgttatggaggaacgagcatgaggacaaaaaaacagaaagaattaagaatacgacatggttggaggcatcgtttcctcgcagccctgcttgttcttagcatgctgttttgccagataaatattaatgttatggctgcctatgcagcaggcagtgattcagtttccgttcaggtaggagagaatgtaaagggaacactgaagaatggagtccttaccatttcaggaaacggaggtacggatgatttcagtgcggataccgcgcctttttctgactatgcggaggaaatacactctctggttattgaagaaggggttacttatatcggcgcatatgttttttatggccttggcggattaaaaggagagctggtacttccggaaagcattaccggctttggcgattatgcattttccggacataataaagaaacagcgcccgggtatacagctattcgaaatcttttctcgggtaaagaaatcgtacatactgagaaaaacgaaacagagccggatatgactacggaagagaacagtcaggaaacggaaacagaggaaacggaggattccacatctacagcagcggaacaggaaacggaatcttctgtagaaaaagaaacggactccactcaggacggccaggaacaaacagaagaaccgaaagaaacacaagaacaggatgagataaaagaatcaaaagaaacacaagaaccaaaagaaacggaaggacagaaagaatcggcagaaaaaacggaaagcccggaagaagccggagagcaggaggcccatgaatctgtcgcttctgtacagcacccggaatcggatcagaaagaagacgaaccacagcaggaaaaagaaggtgtggagtctctttccgccaggaaggaaatacagaaaaaagacaggcaggtgtattctgctgtttatgaaagcaaaagtacacccgagtttttatcggcaggattatccggaagaaaggtatctttgtccactgcaccagagaaagaaaatacggtaattgcggcatcggcggcaaaggagcagccgacggaatccacagaagaagatgaaactgttgagaatacagacggcgctgttacggagaacccggatacgcaggatgctgaaacaaaaaaacagattcggaacgattctgaaaagaaacaatataccaccagttacattacacagcaggaaattaaaaatccggacactcttttttacccgggacagtcagggtgtgtgatttgttcagaagataatacttcatttcttgatgctgcgttggctgccggttaccacttagctgatggtaccgtaaaagtaattcttgatgatcagatagagttagaggtttcttcactgaaaggccggatccaactgcctgagtgtcccgaagaaatcagtgcggcatatgaagaggatgcttttctctctcataccttttccgggtggactgaagatccgtctgaggaaggttcctctttgctgacatccggcagctcttttgatacaaagggcagggaacagatttctctttattctgtgtgggaaagtgcagacaagtgtcaatttgggataaaaaaggaaatcaaagaaaaatatgttgtatacatattaatagataacaatacaggtgaacctgtgagcgtaccggagggctacagcctttcctatcagtggcagattgcacagcagggtgatgcagatgcagtgaactgggcagatattgatggtgcagtgggaaaggaataccgacgagaactgcttccaaagggcagcaggcagcagcttcgctgtcaggtgaaggcggtcaggcttatgcgggcgcggacgaataatggtgaggtgactttttactcagatccggtggatgctgcagtggtgaataatgttatttatgtggatcagagcgggggtgatgataagaagaatggagcttcagaagaaaatgcagttcagacattggagcaagcatctgttttgctggagcaatccgatgggaagagtgttgaggaaaataaaattattctggtcagtgattatcagctgacggtaagtgagtgtaataattttcctactcaaattccggttacaattaccggaaataataataatatttctttgatgggagtaacgaatggtggtgatacctatatagaattgcaggaaggtatccgctttgaaaagcttacagttaaggacttgcagcatatttatggaaatgggtatgatatcacaattggtgaaggaattagaaattccccgcaattttatttatatggtgctggtcggagtagcgttaatgctgttgggaaaataaacgtttacagtggaactgttttaagaattgtgggatatgcaagaagcgtaagcagtgtaaatgttttgggaaaactagctgatattacagttggagggactgcaaatattgataaaattatcggcggttgtgccaatggacaaattgaaaatggtaatgtgaaaattaatgtggaaggcggcaatgtaaaaaccttggtaggaggtaaccaggggtttcagagtaataaagctgcatttaccggggaaaccgaaattaacataaaaggaggaaaggtggaaaatctctatgccgccggatcagggcgtgagcagagtgttccaacttattctggtacaataacaataaatatgcaaggtggtgaagtaggtaatctttatggcgccggttctgcggcttatgtaatttctgatgatgggaaatcttcatctataaagataaatatgcaaggaggtactgcaactaatattttcgcagcaggtaaaggcggagacgatgctgtagaaaagaaggatgaaaaattccctgaaaactcgtttatgttcggaagcttagtgggaacagttgatattctgattagtggggatgcagctgtgaccaatatatacgccagtggagaaggattttataaagataacaatacatatgacaccacaaataatgcatttctggatggaaaagttaccataacacttaaaggaaatgcccaagtcaaagaaggtatttacggcggcggcaagggaattacccaagaagattttggaaaatgtgcgcgggtaacggaagaatcagtcgttaagctatttgttcagggtaatgcagtaatctcaggaaacatatacggaggcggagagaatgcaaggatggaaggcaatgcctatgtatcgttatccgaaaatggtaatataaaaggtaatctttatggcggcggtaagaacggaattgtaatgggtaagactactgtggaaatcagcggaggtattgtggaaggatccgtttatggcggtgcgcttggaataacgggacagcgtctggtttatggtggctccaccattaatatgtccgcaggctgggtgaagggtaacctttacggcggcagtgaattgagtgatgacgggccggaaggaggggatcccaaagatttgatttttgtcaatctcgtcgggggaacggtgagcggaaacgttttcggcggtggttacagggggatcgtgaatggttccacccatctgcatattggcaaaggagcctcaggagaatgtaagtattatcagacatatgttgatgagaaacctgaactgcagccctccatattgaaggtagatggttctgtctatgcaggaggagattacggaggcggtgataagatagattatacaacaataaccgtaaagggtacttcgcatgtatatattgatggaacaggctacaataccggagatgcagaattaatgccggagatgagaatcgccggaggggtatttggcagcggtgcctcttgtgatgcaggatcaacccgccttgtaacattgaagaattacggaactccggttttagatgacagtggattggcaactggtgtaaccagatctttggaagcaattcaaagagccgatcgtgtagttctgtataactctcatatacagctgtcaggtaagtcagatgtggcaaatcctaaccagacgacactgtattcactgaatcgcattggtgaccatggtgcaagggacggtgtagcggaaggagaaaacagcctggtgcttcaggcgggaagtacacttattcttgattccgcagtaatagaaacagctaattttaaaagcatagataaagacgaaaaaaatgtggaattagacaaaattaaacagattccaaatactattctttttgataccggaacagtattccgtgtatcctatacggacgataaatcaaatgaagtatttggtgcagtttccggctatgcttatatgctcgcgggtgataaagcggatgcgtatgcttatgcacgaataaagacagatgatactaataatagtgatggaggattcgcagatcaggccggagcaaaactgaattatgaaaatgtgggaagtgattatcgatactggcgtgttaatggaagtaatgcggcagcggtacgacatacagttctgacagctgaaaccttcgctgtggacagtgacaacgttgataatgaagggtattctgtggtaaccggtagtattgaacttccgcctgccgcgaaaggctcttcttttacaatcacgaatgttattattcccacggggactctggtcttaacggatgcagcccaaaatggaataaaaggggagtggattacctccgatatcaatgaaactccgaatgcatccatggatacagatgaaataaaaaataaaatttcacaagaaaaagagaaactaaaggcttcccctctgacaacctttggactttttatgcgaattggctccggatttattgacgcaggaagtgcgaagggaaaagtgatatccactgcatcagccagtgaaagcgatgagaatactgtgataggtcaatccacggcaaccgctacagatggaggaattccccacatagagttttatcttacctattgtaataaagggataaccagcagtaaaagcctgggaatgctggagatagaactgactcattccaaggataagactaaaaccacaatgtttgtggagattgttacaaaggcaagcacactgtctgatcagacagtggatctttatgctacacagagcggcaattatacgggaagcctggtgataccttcaggagccagccggaatttacggctggcaggagtggataagggaacgaaccttgtagctacaggagctggtgatttaaagccaggggaattttccatcaccatgcagccggtaaagtcccagggctggaatacctcggatcttatgacggaatcgtacgacttaacttcatacaaaaaaggggagaatataaagattggcactacagacagccgctaccaggctgttattgagttcagcctgaaaaacaaccctgtttttaccccaaaagaggagccggataaggttatccttacacttgaggatgataaagggaaagctacagttactcttattattcattggaagtcttctattgttaaatctatggaggcagtgccgggaagagagtataattggccagaaaaagtgggagatatagaatcggtaattatttcacctaatagtgctctgactgtagcaatcgaattgggagaagttgtactgtcagatgagttatggatggaactgagaaaaacagaggatgaccaaatcattgcattaccgaaaggaacgatgctgacgttattgggaatacagggattttacgtttatgaagtgatgggaaatgaagcgaatgacagactgccattaaaaaatttccataagatgtgggaggaaattacactaaaaagtaatataaatagtggtgcagtgctaacttttattattgattttggttctgttgaagctccgcttcctgctgggtcctataatttgcacatacgtaacgaaacaggtgccgatacggagagggcagaatttaccattcagaaccaggaagctgttatcagcttgaattgcggggatgcagagatgaattcaaaaggaaaacaggaatttattttgagtatccagcccaattatgacaccagatggcaaaatggtgctgccgtagttttagcacaagaaaatcccagtgattttccggaaggaacagtattcaggtatggagataaagaatactatccaagtggaaacaaggtttatatacccctggaagatatagatccgcatatcataagcatggataccgaaaattctgccggtataacacctggcagttataagttaacagctgaggtgttcccagtgggtgaaaatgtgggaacaacggtaaaaaaattaacgagcgtttcatatacagttaaaccgaatccttcctatagtcttaaagcagaatcatccagccgtatagcttcagcgggtgagacaattacatttaccgtatcctattccatagagaatgcggaagtcagtcctctgaaaatcgaggtgaaaacccggaaaaaagaagagggaggttatgaaaattcacaaaactggaccgtgaccggaaatgacataattgcagctggaaaagatgatcaaaaaatacaagttactgtgccgaaaaacattacagccggaacctatcgcctgctatttgctttaggagatcaggaggttccatacaatataattgtccagtaggatttccgcatatttctaattctcccataaataaaaagtaccctgcccgccagacacaattctttttccgtgccggacaaacagggtacttttttcttattttttaaatttactcttccgaatcccgttccttaaacctgtccttcatctttccatacagccacatataaatccataaaagaataggaagccccacagtcgccaccagacaggcctggaacagccggtctgcgccgggaaaattcaggcaagccacaaccagggtaacgacataaagcaataccagcagccctacacataccagggccgctatttgttttggtgtttttttctttttatccatttttatctcctcagtcatccacatcaaaagcttccagcttgctctttttaggaattggcttgctgtctccatgctttacgaacagcatggtaaagaaggctgcggttacaaaaagggccgcataagggaataatgtatgatatcctacatgttccagcagaaaaccggaaagaataggagtaacgatctgcgcggccatggaaaaagtataataaaaaccggtaaatttaccgatatcacttcccttgctcatttccaccaccataggataggaattaacatttatggcagcccacgccacgccgaccagcgcgaacagcccattgatccacacatgatattcctttacggtcgcacccagtgcaaacatggacgccagcaatacaacgccccccaaaatcgtttttttgcggccgatacgggatgcaatagctcccacaggaatataagaacaaatagccgcaatcgtagccaccagcagacagttggcaaaaccgccgccctgaatcccccagtaaatctgcgcatatttggaaaatgccgtagtaaccgcattataacccataaaccagaaggaaacggaaatcaatataagtatcagactcctcttaacctcaggagccatcggtgcactgaccgtaccttcctcctgaacagtaccttcttcaatgtccaaagcaagatcgattttttccctctcctcccgcaaaggattttccttgactttccaaagcaggatcagtacagaggcgaccataaccaacgccacaacaaggaaaatagggaaataatcgggctttcctgttttaggaatcagcgtagatatcaaaatcagagagataaccccgccgactgcccccatcagattaatgatggcatttgctttggaacgaagcggcttaggcgtaacatccggcataagcgaaaccgccggtgaacgataactccccatagcaaccagcgtaacacacagcgcggtcacaaacagcccaagagaaacaatattatcagcaaaaggcagaaacagcatcgcaatgaccgccgccgccgtcccgcacaaaataaaaggcgtacgcctccccagacgggtatgtaccttatcggaaagacttccgaaaaaaggaagcataaacaacgccagcacattatccatagccataataccgcccgaaatagtatcactgatatggaaagtgttcttgagaaccaacggaataatgctgtcatacagctgccagaaagcgctgatagacagaaaagccagacctaccagaatagtccgttttgtgttgagcttcataagaattacctcactttgcaagtttgtctagttcttatctaatgatatatcattgacgctgaaagggcaatgatataattgcgcctgtaattgtaaaatcaatgaaaaatattacaaatcacatgaaacacagtaccatcgtaatcagtgactgaaaaacaccgccgtatccattcccaaaaagcaaaatcccgcctgcagcactgctgctgcagacgggatcctgaactaggggaggaatcctccccgtaatgggaggataagtaattatttatcttgcgtaatcacaaaccggaaaataaccatccgattcatgaatcatcaaaggagggggttccgatgataataacagtatgccccgctgaaagaagactatacagattccaataaaaatttttctatttctttttccacctgttccggattatccagattagtgccgtgatgtgcattttcaattattactaaacttgaatttcggatatgctcatgaatgtattgctgctgccgccgtgtcatgctgtcatggtcaccaataagaattaaagcagggcaagtgatctttgacagtccgtccctgctctccatacttgttacagccttccaaacacgattaaaagcatcatgattgagactccctacaaccctgcggatatacggcttggcttcggggttaaaatttcccatacccgcagatatactccatgcaatccagctcataggcataaagcgtaaggaaaagcggttaatcggaagaacaatccgttcataattattaaaccggttggtacatatagcccctatcagtataatacactcaactcgctccgccgcataaattgctgtctgaatggcaacgtgccctcccatggaaagaccgcaaatgactgcttttggaatactcagaaaatccatcattgcaactacatcctgccaaaatatatcgggtgacacttttcccggagggagggatgattttccatggccgcgggcatctaaagcgattaccctataatctttagaaaaatatcttatctgttcatcccactggtgcatatcccatgcggcaccatgcagaaaaatcaatggattaccactgcctgtttcttcaaaatagagctttgcgcctgaattttcaaagtacggcataatcagcctccattctccggggcataaatcccggttcttaacaattcgatatacttatcaaattcagaataaattttttcatcaaagactaacccatgactattgacttcacgcacaaaaccctctgcaagccacgtgacagcagcaatagcagtattgggagaaaccccttctttcagctttgaccagtcaatattaacagcaacccccgcatagcttttttgtaaaagctctttgtttttatcttttatctcaaaggctacatccgggtgttgttcataatatgcagaatataagaaattccataaatcaggaaattgtttgataaatgctatccttaaacgcgaaatctgcttcagcctgtcaaaaaagtccgtattgcttgtatcaacctcctttcccacactcttgcttaaagccgcagtataagtatcataaatataaagatagacctgctttttattttgataataatggtaaaataacccttttgatatacccgcttctgctacaatttcatcaactgtagtttttttatacccatactttgcaaataaagcagcggcggcatttactatcaaagtatgcttttccgtatcctgcataatatccctccacaatcgactaaaatcgtcggttttctgcattataacaaaaccgacgattttagtcaatccatttgctagaaaagctaagggcgctgcaccgaagaaaacaaaaagcagtgaaagttttataccccttcccttgatcatgcgccgggtttttgcttgctggcctcatcccaaacccttataaatcgccgtttaactttgtatgtatcctaactttttcaagaaatcagcatagcgaattttttgaattggtatcatatggacagaattgacaaaagcaatatattcattttctgtcagccatctatatgccactgtttcaccttcttgaagtgatactgttgttttgccgcaatccgtaatacaaaagaattgatagtaaattgtatcatgggaaatataccggcctatttcctctaagaaaatcgctgtaatgcccgtttcttcaagcaattcccgtttcgcacaagtaatcttgtcctcaccttttaatgcagaaccaccagcggttgcctcataatatcctccgaaatttggtttgcggaaatctctttgcatgagcaaataatcgccgtctatatggcgaactaagatttcacataccatatgatataaaccattgggtattggttctccgcgaactaaatctttatttgccaacgagccatcttcccaatatccgtcccatatttccatcttctcaacctctcaaaactaaaattttccattttcttattttacacattttaccatcaagatgtaaatttttctactctccaataagcctgtatagccgccaagatagcgaaaacaacaagtgcgttctctctctcatagtattgtattcccttatatccacatatctacccgtatcttttttacctccctactccgacacccttccccgcagaagaatctccttgtgtccctctccctgcctggggcgtcccggattttctccggcagcgggttctatggtccgacagcttcatctcaaaaaaagagagctgtttcttactattttgcacacagactccgctgcccgcccttagcagcgctgtttgacgaccaaagggaggagtttcagctgcgttggcagcggagtctgcgtgcaaaatagttagaaacagcctctttttttgtctgaagctgccggaccatagaacccgctgccggagaaagtccgggatgccccaggcagggagagggacacaaggagattcttctgcccacccaccaccacccacagtatgcaatgacccgctggactttaccgccattttgttatatactattcctattctgagcgtcagcaaagaaagatgcggctaatcctgcagcagcaatgcttaagaaagcaatgctgaataaaagaaccggtcctgaccggtgaaaatacatggacgaggtgataaaaatggcattattggaacaatggagagcaatggcttactctgaaacagccaacaaagcagatctgcagagactctgggcagtatattttgaaaaggaaaaagagatctacgcccagcttttaaagaatcctgacgaggtggttacaggtaccgtaaaggaactggctgaaaaatatgatgtggatatcatgaccatgaccggtttcctggatggaatcgacgacagccttgcggaatccaatcccattgaagaaatggaagaggatacccaggttagccttggatttgataaagcccttctgtataaaaatatggtagcggcaggcgctgactggctgtatgaactggaagagtggaacgatatctttgacgaagatacgaggaaggctctttacaaggaacagaaatcttccacaactatcgtgaaggataaaaaagtatatcccaatgatccctgtccctgcggcagcggaaagaaatacaagaaatgctgcggtaaaggcaaataaggcggaatgaaaatgaaaagcagaatacaggatgcagttaatatgtttgaatcgggctttaactgtgcccagtctgtttttgttacctatgcagatatcttcggaatggacaggcagacggcattgaagcttgccgggccaatgggtgccggtgtgggacggatgcgtgaggtatgcggtactgtgtcggctatggccatgctttccggcctgaaaatgggcaatacggatcctgccgatgaggaagcgaagacccgttcctatgaaatggttcggaaaatgagcgatgccttccgtgagagaagaggcagtataatctgccgtgagcttctgggaatgtcttccggaatgcagcgggaagaaagtgcgaagccttctgcaagaacagcggaatattatgcctccaggccctgcagccatctggttgcggaagcggccgggattgtggaagaaatgattcttgaaatggaagaataaagttatacgaagagaaactcctgtgcgaaaaggtacaggagttttttgttttaggaaaaatcagagggtaagatcagcatcaggaagagcttgacaattctattttactgtaatagaatgaatcatagatattctactgtagtagaacgaaagggaagatcatttcagtcttcctgatttgtatacggcttcagccgcataagtgcgcaaaaagcacagataggagcaaaaatgaaacgatacctgatgatttttatgctggttattatggtaacattctgtatttcctgcgaaaaagggccgggaaataccgcatcggataaggaagagtttacggacagcctgacggaaactggcagcggccttgcccgccaggtggggccttcggaggagatccggatataccggggagaggaatatatttctctgaaggaagatacggcggatatccgctggtatgactgcagaaatatggacaaaaaggagaaggcgcttctggagggctgtgttcccaatattacctttaacgaagagacggttttcccggaagaaatgtcggatacctttcctgccaaagaatatctggaagcagggaaaaagcccggactgggtgtggaagccctgcatgaacaggggatcacgggaaagggcgtatctatcgcggtgatcgatcaggtcctttataccggacatccggaatatgcgtccaagctggctctttatgaagaaatgcatgtcacacctaatcagacgggttccatgcatgctgccgcgcttgcttctctgtctgtgggagacagctgcggtgtggctccggatgcgaagctgtacttttgggggttggataatgtgttaagctggaaagaggacggggaaaataatcttgcatgggaggaatatgcccgcgtgattgaccggattattgaggtgaacaagacattgcctgaaaacgataaaatacgggtgattgccatagccagaggctatgattttaccggagatgaggaagaggataaacggctgcaggtaatgcttgacgctgtggagagggccaaaaaggaagggatatttgtgcttaccacttccacagaacagaattacgatttcttttccgattatcagacagaagcgccctttgcggggctggggaaaatagatcccgctgctgatccggattccgttgataattacacgctgggtgcctggcagtggtccagcccggatatgtttgccaattcccttctggttcccatggacggacgtaccacagcggatatgtcgggagatacatatgtttattatgccgacggaggctggagctggactgtgccttatgtggcaggagtttatacactttgctgccaggtcaggccggatatgaccccggaggagttttaccatgcggctatggagacatccacggaaattacccgcatgcagccgggaggcagtcaaagctacacctttcatgttatcaatcctcaggcccttatttcctgtttgcaggaagaacgctgacagaatttttgcaatacgccccgttggaatatctgacggggcttttttgtgcgcaaaaaataaaaaaggaaggaggaacacgctcaggtatatcggaaaagggcggaacggagcgccttccgtccatatctgcgtacatcattcttaataaatataaaaatattgtacgcagggaaacattatttcaaagggaagataaaatcttgtgagttgttttccttcccgggtattgatactattagagataatacggaagtattgcgccgataccgcggctggagggcggtgaagacagagaattttttgataaaggaggaaaggattcctatggaaaagataaggtttcctaaagattttatatttggcacggccaccagtgccgcccagttggagggtgcggccggggaggatggcagggggctgtcgatctgggatgccttttcccggataccgggcagtatagcggatggttccaccccggaaaaggcctgcgacatgtatcacaggtatgaggaggatctggatttggcgaagcagatgaatctggacagttttcgtttttccttttcctggtcaagaattctgccggaggggaaaggcaagatcagccggaagggaatcgatttctataaaagactcatagacgggatgcggaaacgggatttggttcccaacgccaccatttaccactgggatctgccctatgagctggaacggctgggcgggtggcttaacagggatgttgtggactggtatggagaatatgcatcgatactgtaccgggaattcggggatacggttccgctctgggcaaccgtcaatgaaccgattgcaacctatgtgggatatgcactgggcggttttgcgccggggtttaagctggaaaaatacggaaggcaggcaaatcatcatattcttcttgcccatggggaaggaatcagacgtttccgtcaggaaaatctgaaggacagcaaggccggcatagtcgtggatgtatggcagcattatcccctgcgcccggacaatgaaaaagactgtgaaatagcccgtcttgaaaatgaaaagacattccgctcctacttaaaccccatattcaagggctgctaccgccaggaactgctgcagtatatggaagaaaaggattgcatgcctgtcataaaagacggtgatatggaacggatacaccagcctctggactttttcgggctgaactgctacaaccgggtgttagactgcgcggaaccggagtcggcgccggatcggaagaaaaacggcgggaatttcatggagaatggaatggagttttacccgaaagccgtttatgaagccgtggaaatgctgaaaaaggattatcagcttacgattcctatatacataacggaaaacggcacctgcaactgcaatgaaaaggtgcaggaagacggacgcatccgggatgagcagcggatcgaatatatcaggggaaacctgtactggattgcaaaagccatagaggaaggcgcggatatcaggggatattatgtctggtcgctgctggataactgggaatggtgcgccggctttgaaagccggttcgggctggtgcatgtggattttgacacacagaaaagaacggtaaaagacagcggcagatggtatgccgggattgccggttccggagaaatggactggaaagagggaggattatgatgaggatcgaggacagagagaagctttttgaaaaccctgcgggtgaataccggggaaggccgttctgggcatggaacggaaaactgacggaggaggagctgctgcgtcagatcgatattttccgtcagatgggtttcagcggttttttcatgcattccagaaccgggctggagacggaatatctgggggaggaatggttccgcctgataaaccgctgcgcggattatgcggcggagaaaggaatggaggcctggctgtatgatgaggaccggtggccctccggatcggcgggaggtatggtgacaaaaacggaagaataccgggcttctttcctggaaacgagagagtataccgcacaggagtgggcggaatatccggggacggagaaggacgtcgcttcctttgccatagtatttgaagacggtgatatgcggaaggtacgtcctttaaagcgaaaagagcttccggaaaaagatgagactgcggttgtttttggagtcatcctggcggaatgcagcgataattataacgaattcacttacgtggatacgatgagcagacccgctgtagagcaatatattcagcttacccatgagcgctacgcccgggaatgcggagcgcggctgggagaaagcattcccggcatttttacggatgaaccccacagaggcccccttttctccgtgttttccggcggaaaagaaacggcggtgccttatacccccgccctgtttgctgaatttaagaagcgtttcggatatgacttaaaggaaaggctcccggagctgtttttccggtatacaggggaggagctgtcggcagcgtccagagattacatcgaattgtgccaggaactgttccttgagaattttgcgcagccaatccagaactggtgccatgagaataagctgctgtttaccggccatgtccttcatgaagacagcctgacggcccagactgtgatgcagggttccctgatgcgcttctatgaatatatggattatccgggagtggatgttctgaccgagaaaaacgacaactggtggatagtgaagcagatagcctccgtggcgaggcagctggataaaaagtgggtgctttccgagctgtacggctgtaccggctggcagatggatctggaggattataagcaggtcggcgactggcaggcgctgttcggcatcaaccttcgctgcccccatctttcctggtatacgatgaaaggggaggctaaacgggattatcccgccagcatctttttccagagcgcatggtatccggaataccggaacctggaagattatttttccaggatcaatgtgcttatggccgatgcggatccggtctgcggcgtcctggtgatcaatcccatagagagtgtatgggcgcgttcccgcagcggggctttccgcggcctggaatctgtccgggagggcatcaatcggctggaagaaagatatcgggataccttccggatcctgacggacaatcatattgattttgattatggagaagaagatattctcgcccggtatgggcgtgtgaaagacggcatgctctgtgtgggcaaatgtgcctatcacacggtgcttgtagccggaatggagacgatgcgcacctctacctgggaactgcttgaggaatacagggaacagggaggcaggcttgtctttgccggagaggcccccggttatgtggatgtgaagccctccgaaaaggtgcgggaactggcccggcgtgcacagcagatcccctttgaggaagaaaaaatcgtggacagctgcttggcgcagcaggcggagctgacagggaaaaatgcctcccgtattgccgtacagatgagaaaatccggtcaggaaacatttatctttctgctgaatatggatcgggaccgcgccgcggggaaaataacactgtccctggaaggtgacggttatccggagctttgggatgcaaagagcggaaatatatatgcctgcggctgcaggaagaaggagggaaggatggaaatcccccttaccttcgccgcaggggaagagaagctccttgtggtcaccgatcaatacagggaataccccgaaccggaaaagcacagctgggaaaaaatatcctgccttccggaggaatatgactatcagctgtcggaggaaaatatatgtgtgctggatatggtgcaggtgacgctggcggatggaagaaggctgccctgccgtgaggtattgaaggcagacagggagcttcgtgatatcctgggaatcccctggcgcggcggagaaatgctgcagccctggtatgaggagaagaaaaacgggatacctgcacaaccgctgtctgtgattaccatggaataccggttcgaagcggaagatatcccccgggaatgttccctcgccctggaagatctggagcatgtgacgggcattgcattgggagagacggagattcctttgaaggcggagggtaaatggctggacagctgttttgacagaatcatcctgccgtcaggctgtatccatgagggcgtcaatgttctgcggattacgtatgcttattataaaacctgcggaatcgaagcggtgtaccttctgggagactttggcgtgagactggacggcggtaagaaaaaggctgtgctgaccacacttcccaaaaagctgaaagcaggagacatcacaactcagggacttcccttttattccggccgtatcctttatttccttccggatttggaaaaagggctttataaaattcgggctgcgggaacgaatgcagcctgtgtcagggtgacaggcagggaagacgctttgatcatgcaggctccctatgaggctgtgagtgaagatccgcaggccatcgaactggtcttcggcagaaggaataccttcgggccgctgcatcagtggccggccgtggatacggcttacgggcccggaaattttgtgacagaggggaagtcctggagagattcctatgtactgataaagcagggacttctgaaggagccggtaatatggaaggaaagaaaggaaaccgcagatgaatgacagaaccattttcaggattatggataaggagacaaaggatacccttcatcccgatgaaaggaagagtgtatatctgcttccgcacaggattgtgtggaaacagggaaaaataagcaatgaggaagtgcttctgaaggaaagggaatcccagatatctctggcggcatgggatgactgtgtaatggacagcacggacgggcaggtctcccttctgctggatttcggctatgagatacacggcggtatccgcattcttgcctggaaggacagtacggacaggggggcgagggtccggatccggttcggggaatccgtaatggaggccatgagcgagcccggaggggaaggcaatgccaccaacgatcatgcgagaagggacatccgtacggaaatcgggatgatgagcatgaaccggattggggaaacaggcttccgtttcgtgagaattgatttggaggaggagaacgccagtctttccctcaagtcaatagccgcggtgctggtatataaggatgctccctatctgggcagtttttcctgcagcgatccgcttctgaaccgtatctgggacgtgggagcctacacggtgcatctgaatatgcaggaatatatctgggacgggattaaaagggaccggctggtgtgggtgggagatatgcatccggaaacactgacaatccgaaccgttttcggagcggacgcgtctgttgccaggagtcttgaatttatcaggaaagagacgcctcttcccggctggatgaacggaatggcaagctataccatgtggtatgccattattgtacatgactggttcatgtatacgggcgacttggaatggctgcggagccaggaggaatatctggaaggcatcagcaggcagctttcggaatgcatcgatgaaaagggaaaggatacggtgacggaaggccgtttcctggactggccgtccagtgacaggcctgatgtggtggacgccggtgtacaggccattcacctgcttgcggcggacagcctgcggaagctgtttagggcgctgggaaagcaggggcctgcggaggaatgcgcccgggatatggaaaggctggcctgtttcccggctgatgcgggcggatccaagcaggctgcggcactgcttgtactcgcagggcttcgggatgcggaagaaatgaacggaagcgttctcgcagaagggggcgcggaagggatgtccacctttatgggctattatatcctgaccgcccgtgcgatggcgggggattatgaagggtgcctcgcatgtatccgcgactattggggcggaatgctggaactgggggctaccaccttctgggaggatttcgatgtgaaatggatggaaggggcggcgcctatcgaccggttcccgaaggaaggggaaattgacgtgcacggaacctatggggattactgctacaagggataccgccacagtctctgtcacggctgggcgtccggcgtcaccccctggctgaccgaaaatgtcctgggcgtcaggataatggagcctggctgtaccaagcttgaaataaagccccacctgggaaatttatcatgggcgaagggaaccttccccactccttttggcgttgtccaaatttcccataagaaaaagaaggacggcagcatagagtccaaaataaaagcgccggcaggagtgaccgtcatttcctgacccggataggaaacggcttgtgatacgtgcgccccgggcgcacagagggagagggaatggaaaagaaaatatttcagaaggcaaggccggtctttgtgccgggaatggaagctaagccggatactttggcggcgttccggtgtaattttacggcgcagcctggcaagacctataagctggcaattgccgcacatactttttacagagcatatataaacggcgtattcctgggagcgggcccggcgcctgcgccctttggcatgctgaaagcggaccgataccggctggaagggctcaaagaagggcttaaccggctggctgtggaggtgattggttatgtaccctcggaaaataattatgcgacacatgagacctcctgcctgatcgccgaactcacagaggagaacaaggtgatctgcgcgacaggagatgccggttttacctgtggcctgctgacacagaaggactgtgaagcggaaactctgtcctttggccggagagtccctcttgaggcctatcgtctggatgaagcatataccgcatggaggacaggagcaattcccggggcagccgcctgccgggagacgggagaagagaggataatcagggaaagaggcacggccatgccggatttcagcattcgggaaggctttcggatgcttggcgtttacagcctccgggaacgcccggaagaatggaaagcacagagctggtgggaatcggatgcctatatctcccgctgcggaggaaaagggatgaagcggcccgcgtacgaagattcccttctggaagatacggtttatgagggaaggctggaggaagaaaaaggtacggacggcagacgtatctataagctttccggacatgaagctcccgcggttctggaatttgtcatggaggaggcggaaacgggatttatcggcatcgctttttcatcggaagggccggtcacggtggatattctctggaatgattatctggacggccgcggactgcttccggtaaaagcggataacgttaaccgcgtgatacgtctgcattcggagggcggaagctttgcctttgaagcgatggagccgcatttcatgaaatacatcaaggttatattccggggaggaaaaagtgtttccctggattggctttacgtgcgcacctatcatttcccggattccccggcatccggttttgtctgttccgacaaggagatgaaccgcatttatgaaggggcaagacggactctgctgacgaattccctggcattcttcctggattccccggagcgggaacggggaggctgggccggtgacagctactggacgggcagggcggcatccatgctgctttccgatacgaccctggaacgcagtatgcttacggatttcctcgcggcggattattccgtgatgcaggaaggttcgttcccggcctgctgcagcggcggagccaggaaagatccgtgcatgatgtattcctggaacctgtttctgctgctggagctgacggattactacaggaggacctgggacgaggaaatgaaggaggcctacagagaacgtgtaagcctgttcctggaggcttcccaggcttataaaaacagcctcgggatactggaaaacatccccggctccatgttcatcgactggtcccaatccaacgatacgtcccatacggcccccatctgtacggcggcaaacggcctttatgcattcaccctgcagcgcctgggagaaatgtatcacaggacggattatatagaggaagcggaacacgtccgcgctgtgttccgtaagttttatgataaggtgaagggcagcaggaacgatttgttcaccatgtatccctttttgccggattccatgacggtcacggaggatggattaacgggaaacggcgcatacagcgaagccgcgcagtattattatttctggacggggcttctgtccgtaaaggatgcgtctgccctgtggaaaatactgaaggaggaatatggcccctgccctgaaaagtacagagggaccgcacacctgagagtaggaaactgcggtgtgttcttcggatatatgatgaggttcgaactgctggcccgctatggggaaacggctttgctggaaaaagaaatgaagcacctgtgcggctatatgctgtcacaggatccgggaaccttctgggagacgctcagcggaacggacagcagaaaccatggcttcggcgcctattacggcgcgattgtcatgcgggtatttctgggaatggagattccggacagagaaaataaaagagtgcgtttcgcaccccgtccgggcagcctgcgatgggcaaaaggaaccatggataccgcggacggacgcatcagcgcgttctggagcctgggcgatgaaggaatccgtatggaaatgagcgcgccggagggctatcagattgaagccgtcatcccggaggagtacggatttgcccgctgcatgacagtcaatggagcacagacggatatttccggcccgatcctgacaggaaacaagcttaccctggagcttcacaggaaggaatgacaccaacttcgtaaatgtcccaatccccggccgccgctttggcttatgcacgaagccggtaccaacagaatcagcccttcccgttacggaactgggaaggagtaattccgatttcctgcttgaatttccggcggaagctggagacattaagatatcccacacatacactgatttgatcaatgggcatgcttgtattaagaagcatgtcctttgctttggccagacgcagctcccagagataatcggaaaaattcttatcaaatttctttttgaaaagataactcatgtaggcaatactgacctcgaatttatccgcgagtacggaaatggagaaatcgggcgaggtatagcattcctgcagaatctccattatctgggaagcgtgcacggcggaattggcatattccgcctcgaaggtggccaggagttcatccacattccgggaaatttctccccccttttcctgataaggacagctgcggcataaatacagcgtttcaaaatagagatcgctgtaatttttaaatttaatattcatccggttcatggcattgatgatgatagtcaggatatcgatcaagacacaccggataaagaagtcgggaaaaagagttccgttttcagaggcgctgtcgatctgggaaaagagctcttttttcagttcatgggcctgtttgaaatctggcgttttcaggcatagggcaagggcatccagatttttgtaaggataagccagattggaaggggagggtatcaggggagcgatttccgtataggagaccactgcggcatcctgccggtacttatcggcaagcagggcattttcataaaggtagggaatttccagaggggaggaggctccgttgctcacggccgccgcacatcctgtttcccggcagtagtccgacaggagaaggcggatgacctcgtccttgttgtcttcgatccccggataatttatcatgaatatcccatgtgttttgccggcttccagcagggcgcaggaatttttatcgggcagggcgttctccagatattccacaacctcattggcattgaaattttttctgggaaggctgattttaattacaaaaatcatgttgtccggttcgtcgctgaaaaactgatcaatatccatgattccgttcattttggaattgctgctgtcggaaacgatggaatccagaatggatttctgcatggacagcctgtatttatccagttttttctgcagctccttcttttcggacagcgctgtggtgaaggcggcatctatctgatccacatagctgcggcccggaaggggcttgtccaccagcttggtgagcagcctgtgaaggggccagtaggtgatccgcatggaacaaaggatcaggatgatcccgcaggcggccagcagaaccagtatcatataggtattgcggaaggccaggctgacctgatccagtatggctttgttggaggacagcgccagcagggacagatcgctgggaaggcctttgtatacaaacatgctgtcgtcggagtcaatggggtagcagccgggttcttttaccaggccgtccagatagggccggatggtatccgtatgaatgccggaaactatccggttgtccgaggtgacaaggcaaacggaggtgatgccgttaaaactgcctgtttccagggttgtctgaagatccttggcactgatgacatagaaaatggagtaggattccacattgctgttgtaaggcagatagagaagcaggctggaggtttcgtcagacagaaaaatgagctggcttttattggagtccgtatactgcatcatgggaaaaggaaggtaatgggtgccggtatatacataatagataccgtcctccttataaacatgcttgccggaggatagaatactgtccgttttattgtccacatagacaatggtatctataaaactgttgctcaccgtatattcattcatacgctgggcggcctgatagttgtaccagttttcatttttataacgggaaagaacaagattgatatcattggaaagcagggaatgcacctgattgacatccgacagatcgtcatcgagctggagcatgacgtttgtcagacgtttatcggtctgatccttcagatccttaaagtaaatatgattcagctgcaggcggacggcgaggaagaagccaaggaaaagaatgctcagaatgatgaagtaggataaaaaatatttaatgagcgtagtatttttgctgcttgaaaaaagacgggccgtgtatttcatagggtctcctttgtatatcagaaaatatatgattatcatacaataaatggaaattaggcgcaatatcgggaaccgcttatcctgcccgggcggacggaacagtttttaaataatttttttgttatttgtatgtttacggcgaaaatgccggaaataagcgggtttcaggcggcaaaagaggaatacagaatttatttgttaatggcagaatcatgtatcttgatgatatagatttgtagtacctataatagagccaggctcacaaagcaatggagaggcgcctccgaatgacagatgagtgggcatataaaggtattgacaaaaaacaggaggtattacttatgaacatgaaaaagcttacggcattgttctgtgcttttgcaatgacgttttctctgacagcctgcggaggagcaaaagaaacatcggatgcggcagctgtcccggaaagcagcaagacggctgagggaactgcggacggaggggcagacacaggggaaagccaggcgtccggtgatgccataaccttccctttggcagagacaaaggaatacagtgtatttgccattttgaatcaggaatacgatttgcaggataatatttccatgcagaccgtaacggaagccgccaacctgaaatttaatttccaatctgttatgggagcggatttgaaagaaaaaagaaacctggttcttgcttccggggaatatcccgatatgtttttcaaggcaggctttgaggcgaatgatttggagaaatacggaaaacagggactgttccttccgttagaggatatgatcaaacagtatgcgcccaatctcagcgcaaggctggatgaaatggacggctgggattatctcacatcctcagacggacacatttattccctgccgggcatcgagagacagaatggtgcgatgacaacctattggatcaataaaagatggatggacaatctgggcctgcaggagccgaagagcctggatgagctgtatgaggtgctgaaggcattcaaggaagaggatgcgaacggaaacggggatccgaacgatgagatacctctgaccgcaaccgatgtggtgaaaccggatctgctgcttgcttactttggcatcccttatgattatgaaaccaaaaccgctgtgattgacggggaactgacctatatccccacttccgaaacctttaagaaatatgtggaatatgtggcaaagctttaccaggaagggctgcttgacaagaatgcatttacccagaagcatgaacagcagggagccatcggccagtccggcgatgtgctgggaagcttctttgatgcaggcgcattccttacggtcggaagagacaacgatgacgattacatcgccctcacaccctttgaagacgggctttatcctctcggtaccggtattgttcccggaaccatggttttgacggacacctgtaaggatcctgaggtcctgatcgcatgggcggatcagttctatacggaagaaggcggtatcctgacatggctcggtatagaaggaaagacctggcagatggatgaggacggaaactgggaatggattgtcggccagggatacggcgacgatattgcgactgtacgttccagctctaccattcagggagcggcataccatccttccatccagcctgatttctggtttgacaagatgtctgaaaaggttgatccggatgaagtatatttgaacggagaaagagccaaggtcgctgcaaaaggcgctgttccgctgccgatgatgcgctacagtgacggcgatgccaagaccatatcaaccattaagcctgacattgacgcatacatagaccagtacgtggcacaggtcgctaccggagaactcaatctggaggacagctgggatgaatatgtggcaaccgtaggaaacatgggcggaggccagctggaagaaatctataaaaatacctataaggaagccataggaaagtaaagagaattacagagaaacgcataaggccgctgcggaatgctgtagcggccttatctttgccaggaataaaattaaattcaaagggggaaaaccaatggctgcagggaccaagggaaaaatggccgcagagaagaaggcaggatttgcaggaagacagacagagagcttgccggtccgcctgctgaaggacatgagaaaaaactggattctctatgtgatgattctgccggtggtcgtttattatattatatttgcatatgcgccgatttacggcatccagctggcatttaaggattatatagtcaaaaagggaatctggggaagcccatggattggaatggaaaatttcacccgttttttcagcagctataatttcggactgctgctcaaaaacacaataggaatcagtgtttacagtattctggtcggctttcccattcctattattttcgcattgatgctcaattacctgaagaacaaatatctgaaaaaaacggtgcagatggtttcttatgcgccttactttatctcgaccgtagttatgtgcggtatgatcactatttttctgaatccggatacggggattttcaatacgatcagaggctttttcggaatggaaagcgttgatttcctgggaaaaccggagctgtttaaatcgatctatgtatggaccggcgtatggcaggggatgggatggagctccatcatctatatatcggccctgtccggagtggattaccagctgcatgaagctgctattgtggatggagccaacaagctgcagcggatccttcatgtagatcttccctccatcaagccgaccattgtcatgcttctgatccttcagatgggctccctgatgagcgtgggctttgaaaaagtcttcctgcttcagaataccctgaataaacaggccgcctctgttatatccacctatgtatatgaagtcggcctgattaacagcgattatggctattccacggcaataggccttttcaattcggttatcaatatgatactgattgttgcggcaaaccagatctgtaagaaatttacagaagaaagtctgttttaggaggggaaaaaagtgaataaaggaaaaacagaaaaaataaaaaaatcctattcggacagggtttttgatattgtcaatatcattattatgctggcccttctggtgatttttctctggccgctgtggtttgtggtcatagcctccttcagtaatcccaacgaggtatggaacgggaatgtcatcctgcttcccaagggctttaccctgtcggcatatgaggccgtttcacaatataagatgatctggaccggttataagaacacgatcatttacacggtggttggtacctttatcaacctggtcatgaccatatgtgcggcttatccgctgtcaagaaaggattttgtcccgcgcaacttcctgatgtttatattcatgctcaccatgtatttcagcggaggcctgattcccacctatctggtggtgagcaaaatgcatcttctgaataccccctgggcaatgatgataccgggagctgtttccatttataatgtcattataacgaggacctattttgtgaacagcattccctccagcctgcaggaggcggcggaactggacggagccaataccttccagttcctgatgaaaatcgtccttcctctgtccaagccgatcatagcggttatcgccctgtattatgccgtaggccactggaatgatttcttcacggcgctgatttatctgaatgacaaggaactgatgccgcttcagtccttcctgagggatttgctgatgtccaataaaatgagcctgaacaacatgcagggactggatgccgcacaggcggaggcaaagatgcagctgtcacagacactgaaatacagtgcgattattgtgtccacggttccggttctgtgcatttatccgtttatccagaaatattttgtaaaaggggttatgatcggatctgttaaaggatgatggaatccgtaagctccgcctgaatatacggaaggttatcttatattataatagaaggctcccggccgacaggatgatttcctgtccggatgggggcctgatttatgtccttttccggctgtaaacggcattcctgtcaattgttcatttatatgaggtgccgtacagaccctatggaaaaccctaaaataatgcacataaaaatacaaaaaccaggctggacgagaacaattatatacaaaatatcacatatctgactatagccggattgaccgtgagccattataataaatttaataagacattcactgcgcaataatacgccgcatatggaggattgctatgcaatatggacattttgacaatgaaaaaagagaatatgtgataaacagggtggatttgcccgcctcctggactaattacctggggctgaaggacatgtgtgccgtggtgaaccatacggcaggcggatatatgttctacaagacgccggagtaccaccgcatcacccgtttccgcggaaacagcattcccatggaccggccggggcattatgtgtacataagggacaattccgacggggattactggagcatatcctggcagcccgtgggaaagagcctggaggaagcggcataccgctgccgccacggcatgtcctacactgtatatgaaagcgaatataaaggcattagcgccagccagaagctttccataccgcttgaggatccggtggagctatgggacgtgaaaattaaaaacgacagcgacaggaagcgggatttaagcgtcttttcctattgtgaattttccttccaccatatcatgacagacaaccagaatttccagatgagcatgtattgtgccggttcttcctatgaggacggtatcattgagcatgatcttttctacgaagagtttggtttccagtattttaccggcaattttgagcctgacggatttgactgcctgcgggataaattcatagggccttaccgcacagaggataatccgctgtccgtggaaaagggccaatgcggcggttcctttgagcttggcaacaaccactgcggcagcctgcagaaaaatatcacactggagcctggagaagagatccgtctcgtgttcatgctcggtgaaggcaacagggaagcgggccgcagaatgagagcaaaatataattctccggaggctgtggatcgttcatacgaggaactcagggaatactggaacagcaaattcagcaagctacagattcatactcccaatgagggtatgaacactttgattaatacatggactctgtaccaggcggaaattaacgtcatgttttcccgttttgcctctttcatagaagtagggggcaggacagggcttggctacagagatacggcacaggatgccatgaccatacctcactccaatcccggaaaatgcaggcagagactggaggaattatgcagaggtctggtatcagaaggttatggactgcaccttttccagccggagtggtttgttcctgacaacgaggtcaagcccttcaaatcccctacagtcatcccaacgccgaataaggatgactatgtgcatggtctcgctgacgcctgctcggacgatgcgctctggctggtgtcctccttggtggaatacataaaggagaccggagaatttgatttcgcggatatgcagcttacctacgccgacggcggggaaggcactgtctatgagcatatgaaaaaaatactggatttcagtgccagacaggtgggcagcaccgggatctgcaagggacttcgcgccgactggaacgactgcctgaatctgggcggcggtgaaagcgccctcgtttccttcctgcattactgggcgctgagccgtttcatcgaactggcggctttcctgggcagggaagaggatgtaaagacctatacggagatggcggagcacgtaaaagaggtctgcgacagggaactgtgggatgaggaatggtttatccgcggcattacgaagaacggccggaaaataggaaccagccgggatgaggaaggcaaggtacatctggaatccaatgcatgggctgttctttccggcgccgccagcccggaaaagggaaggctggccatggacagcgtggataaatatctgtataccccttatggaatccagctgaatgcaccctcctatacggtgccggatgatgacatcggatttgtgaccagggtttacccgggactgaaggaaaacggttctattttctcccaccccaatccctgggcctgggcggcggaatgtgtgctgggacggggagaccgggcgatgaagttttatgatgccctctgcccgtattaccagaacgataagatagaaatcagggaggcggagccttattcctactgccagttcattatgggaagggatcacagcgccttcggacgcgcaagacatccgtttatgaccggaaccggcggctgggcctatttctcggcaacaagatacatgctgggaatgaagccggaattcgaccattttgaaattgacccctgtgtacccggagactggaaggaattccggatgacccgtgagtggcgcggagcccggatggaaataagagtggaaaacccggacggcgtcatgaagggtgtcagggaaatccggctggatggggaaaaggttgaccgcataccggtactgccggaaggaagcacccatcaggtacaggtgatcatgggccgctgacaggcgccgcaaaacaggcatgtatacaaatgtgttcaggaaaagggaggaaaaccgatgattaagtttggaacaggcggatggagagcagtgattggagatgatttcaccaaggcgaatatccagcttctggcgaaagcgctctgcaggaagatgaaagacgaaaacgccgcggataaaggaattgtaataggctatgacaggcgtttcctggcaaaggaagccatgcagtgggcgggccaggtgttcgctgccgagggagtgaccgcatatcttgtgaataaatcagcgcccacgccgcttgtcatgttttatgtgatgaagcatgaaatgccctatggaatgatgattaccgccagccataacccggctatttataacggcatcaaggtgttcaccgcaggcggcagggatgccagcgcgcagcagacggatgaaatcgaagaatatatcggccgcattgaaaatgaaaaagtggaggcgatggaatacgacagggcgctggaaaccggactgattcaggaaatctatccgctgaatgaatacctggacaatatcatcgacaatatcgatatgcaggctatccgcagcagcaggctgaagatcgccctggatcccatgtatggcgtgagcgaaacctctatcaagaccatccttctcaccgccagatgtgaggtggacaccatccatgagcgccacgataccctgttcggcgggaagcttcccgcgcctacggcggcaaccctgcgtcctctgcagaatttcgtcctggacggcaaatgcgacatcggaatcgctacggacggggacgcggaccggctgggagtcatcgacgataagggcaaattccttcatcccaacgatatcatggtcctgctgtactattaccttgtgaaatataaaggctggcacggccctgttgtccgcaatatatgcaccacgcatatgctggataaggtggcggaaaaattcggggaaaaatgctatgaggttccggtaggcttcaaacacatttccgccaagatgacggaaacggatgccgttatcggcggcgaatcctccggaggcctgaccgtaagaggccatatccatggaaaggacggcgtatatgccgcctgcctgcttgtggaaatgatagccgtgaccggcaaaaagctgtcccagatctatgccgatatcgaagcggaatgcggcaaaatttatatggaagagcgggattacaagttcaaccaggagaaaaaggatgccgtgcacaaaatccttctggaagacagactccttcctgagcttccctatgaaatggatcacgtatcctatctggacggcagcaaggtctactttaagaacggcggctgggtagtgggacgtttttctggaacggagccgttgatccgtattttctgtgaaatgccggaagaagagcaggcgaaggacgtctgtcggatttatgaagaattccttgatttgaaatagaaagcgaacgcaaaaggcaggtatttccggtaattcggaagcctggataactacatttgatagtgtgttatggattcccagttggccggaaagcccatcatagccagcagggaatcccttccgatcctgctgctttgtttatggtaatgtgcaatactttttatcagggaacgcttgaattcaataaaactctgtctgggcagcagatagcggaaggcaatagttaacccgaacttgctaccgcagctttctttctatctgacagagatatttaaacacaagttcccgtaatgccaggtcaaactggtagagggcatagatatcttcaaaggcagtgttatcttcatagacacgggtcataggattgataaacggagtcttgtacccgccaatcagggagaagtagcctatatcccttaaaatttctttcgctttttcacagtctgtgatgcagagttttttcccatttatcaatttgtcgagttgttggtcatatgtaagaaatggttttgccatatttcaaaccgcctatgtatatttgaggaggatacaggaagtgcgtcattggctccctgccctataaggtataaaaaaggagggccctcaggtcctcccccggtttcagtcctcgcaagtatctgaaacctgatcactaaaaacattttagcataggcagtaagaaaagtcaacgcttttacagatgcttctgcatttgttttcagttatagtatatacaataaggaagaaaaaatgcatgcaaggcgtttcaagtttggcgtcccgatgattgcgcaggagtattttattttggtacagcttccttcagcatttccagaaaaagcgattcagccctgctgggacggtaatcctccggataaatcagcaggtcggtcattttttttggagagccctgatattttttctgtaccagatgatatgcggataaaacggaatccggtaccggggagacaaacataaaggtgccgggaacgcctgtgagaatatcaaactggctgccccgttcatggatgtgtatactgttctcgttatgctccgtatcgggcgcttcatggaggtaggtggagagggcggtgtcgtcacataccacctctatcgcctgggagagcagatccggagtcagcacggaagcctttgccagagggtgccggtccgacatgatgacggctaactcaaatttgcagatggtctcataagaaagctcccgcagcctcagcaggggaagaagcgtcttctcatagcggtcaggatagcggatgacggccagggacgccgtccggtcggatacctgacagatcgcatccagcgttcccgtttcattataattgacggacagctggcggcctttggcatattttttgaggaacgcggtaaaggcgcaggtgatatagctggcccgggggacacagatatgcaggctgatattgtctttttcctcccggctgcagtaattttccagagcctgatactgctttaccgccttttttgccagcacaaggaattcccttcctttctccgtggggattacgccgcgggagctgcgcgtgaaaaccgtaaacccgatttcctcttccagctcccggatgtcacgacttaaattgggctggctgatgaacagctgctttgccgctccggtaatggaacggctccgctccacttctataatataacgcaggacattgagattcatttaggcaggtctcctttcattcgtatccgtgtactttataaagtacaaaggggttcatgggcggctgcatttccgccatgcccgctaaaatccatatctgtgatcttgtatttcattttatacattgtatacaaaatgtatccggtttcgtacaatcaccggaaacctgctataagcatagcttttcctgagaaaaaaagcaatataatatgtaaaaaaatatatagttgccatataaaaaatgtatacccatgcttgtctcataagatgtataatattgagtatcattaagataaatttttaacagccctcaagggattccttaagggcaagtgtgtatgcaagcggattaaacgtatgtatatacactgtaaaaattgactatctataacagagataagaaaggaaggtttttatggcaaggaaaatgaaaaccatggatggtaaccatgcagcagctcatgcgtcatatgcatttacagatgttgcggctatctatcctatcaccccttcttcacccatggcggaagctacggatgagtgggcaacagcagacagaaagaatatgttcggccagatcgtgcacatcacagagatgcagtctgaagctggtgcggcaggtgccgttcacggatctttggcagcaggcgctctgacaactacctacacggcatcccagggtctgcttcttatgattcctaacctttacaaaattgccggcgagcagcttcccggtgttttcaatgtttcagcgagagcaattgcgtctcatgcactgagcattttcggtgatcattccgacgtatatgcatgccgccagaccggctgtgcaatgctttgcgaaagcagcgtacaggaagttatggacctgactgcagtagcacatcttgcagctattaagggaagcattcctttcattaacttcttcgacggcttccgtacatctcatgaaatccagaagattgaaacctgggattacgaagacctgaaggatatggtagatatggatgccgttgacgcattccgtaagaaagcgctgaatcctaaccatccctgtcagagaggttccgctcagaaccctgatatcttcttccaggcaagagaagcaagcaatccttattatgatgctcttcccggaattgttcagacatatatggacaaggttaatgaaaagatcggaacagattataagctgttcaactactatggtgctgaagatgctgagcacgtaatcgttgctatgggttccgtaaatgacactattgaagaaaccattgattacatgatcaagacaacaggcgctaaggttggtgttgttaaggttcgtctgtacagacctttctgtgcggatgcgctgatcgatgctattcctgagactgttaagcagattaccgtacttgacagaaccaaagagcccggcgcacagggtgagcccctttaccttgatgttgtggcagctctgaaggattccaagtttgatgcggttccggtattcacaggacgttacggcctgggctccaaagataccactcccgcacagatcgttgctgtatatgctaattccgagaagaagaaattcactatcggtatcgaagatgatgttaccaacctgtccctgaagctgggcgctgagctggttacaactcccgaaggaaccaccaactgtaagttctggggtctgggcgcagacggtactgtaggcgctaacaagaactccattaagatcattggtgataacaccgatatgtatgcacaggcatactttgattatgactccaagaagtccggcggcgttaccatgtcccatttacgtttcggacattccaagattaaatccacttacctgatccgtcaggctaacttcgttgcatgccacaatcctgcttatgtacgtaagtacaatatggttcaggaactggttgacggcggtactttcctgctgaactgtgcatggaatgcagaagaactggacaagcaccttcccggacagatgaagaaattcatcgctgaccacaatatcaacttctacaccattgacggtgttaagattggtatcgaaaccggcatgggccccacacgtatcaacaccatccttcagtccgcattcttcgaactgaccggaatcattcctgctgagaaggcaaatgaactgatgaaggcagctgcaaaggctacttacggacgtaagggcgaagacgttgttatgaagaactgggctgctatcgatgcaggcgccaagggcgttgttaaggtagaagtacctgaaagctggaagaactgcgaagatgaaggccttgattacgcagtggtaagcggagacagaaaagacgtagttgacttcgttaacaatatccagaccaaggtaagcgctcaggaaggcaatacactgcctgtatccgcattcaaggattatgcagacggctccactccttccggatcttccgcttatgagaagagaggtattgctgttaatgttcccacatgggatccttccaagtgtatccagtgtaacttctgttcctatgtatgtcctcatgctgtaatccgtcctgccgttatgacagaagacgaagctgccaaggctcctgaaggaatgaagatgcttgatatgaccggaatgcccggaaagaaattcgctgttaccgtttccgtacttgactgtaccggatgtggatcctgtgcgaatgtttgtcccggcatgagaggtgaaaaggctctgactatgaatcctcttgaaacacagctttccgaggagaagatgttcaattatggacagtccgtatccgagaagcctgaagttcttgagaaattcaaagagacttccgttaagggatctcagtttaagcagcctctgcttgagttctccggagcttgtgcaggatgtggtgagacaccttatgctaaattgattacccagctgttcggtgacagaatgtacattgcaaatgcaacaggctgttcctccatctggggcaactcttcaccgagtacaccttataccgtaaacaaagcaggcagaggacccgcatgggataactccctgtttgaagacaatgctgagttcggtatgggtatgcttctcgctcagaacgctatcagaggcggactgaaagaaaaggttgaagatgtacttgccaataccgcagacgaagctgttaaggctgcatgccaggaatacctggatacctacaacagcggcgttaccaacggatcggcaacagataaactggtagcagttctggaaggacaggattgcggaacatgccaggatatcgttaagaataaagatttcctgtccaagaagtcacagtgggtattcggtggtgacggatgggcatatgatatcggattcggcggcgttgaccatatccttgccagcggaaaagatatcaatgttatggtattcaataccgaagtatattccaatacaggcggacaggcttccaaggctacacctaccggtgctgttgcacagttcgctgcaggcggtaaagaagtgaagcagaaagaccttgccggtatcgcaatgagctatggttatgtatatgtggcacagatttccatgggtgctgattacaaccagaccgttaaggctatcgcagaagcagaagcttatccgggaccttccctgatcattgcttacgctccttgtatcaaccatggtatcaagaagggtatgagcaaagctcagaccgaagaaaaactggctgtagagaccggttactggaatatgttccgtttcaaccctgctgcagagaagaaattcgttcttgacagcaaggcacctaccaaggatttccaggaattcatcggcggtgaagtaagatacacctccctggctctgaaggatgccgataaggcttcaagacttcaggctcaggcagctgagaatgcaaaagagagatatgaatatctgcagaagctgcaggttctgtacggtgataactaataactgaccatataagggtaagtttgccggacagtatgtcattacgtggctgctgtccggcagcggtacaaaagccgcggacaagattaaaaacataagctggcttgggattgtctcaaatccagctttgtttttaggcacaccagttaattttttaacaatcagaaagaggataaacaaaagaatatgggtattgtatctgatgacgctaccatcttaaaaattaagcacgaggtactcactgaagtggctaagctggcatttgccggtgaattagacgagaaaaaagaaaatcttccttatgaaatgattcccgggcccgaagcgcgtttccgctgctgtatttacaaggaaagggaaattatcagacagagagtcagacttgcagaaggaaaatgtcctggtacaagagaaagcagcaacattgtgcaggttatcaactcagcctgtgaggaatgtcctatttcatcgggctacgtagtaaccgacctgtgcaggggatgcctggcaaaatcctgtaagcagtcatgtaatttcggcgccataactatcggagataaccgttctttcatcgatcaggataagtgcaagagctgcggaaaatgttcccaggcctgttcctattcggcaatcgtaaaaatacagagaccctgtatgaagagctgccctgtaagcgcgatcaccatggatgagcatggagtatgccagatcgacgagtctaaatgtatccagtgcggacagtgtatccataattgtccttttggagccatcgcatccaaaacaagtatcgtggatgtcattaatgaaatccgtgccgggaaaaaggttgtgaccatgctggcgccggccggtgaaggacagtttggcgaaaatattaccatggcgagctggaagactgctatgaagaagctcggctttgccgatttcgtggaagtaggcctgggcggcgatatgactgcggcttttgaagcggaagaatgggcggaaaacttcaaggaaggcaagaaaatgaccacctcctgctgtcccgcttttgttaactatataaagaaacatttccctgaattggtagataatatctccaccacagtttcccctatgtgcgcggtatccagaatgctgaaagctaaggatcctgaagttattaccgtatttatcgggccgtgcatcggcaaaaaatcggaagcacaggataagagtattaaagggaatgcggactatgtcctgaccttcggggaaatccgcgccatgatgcgtgccaaaggcgtagaactggagccggaagagaataccagtcaggaagccagtgtattcggaaaacgcttcggcaatggcggcggcgtaaccgaagctgttgtggaatgcctgaaggaaaccggtgaaagcaccgatattaaggtggcaaagtgcagcggcattgcagactgcaagaaagcgctcatgcttctcaagctgggcaagctgccggaagatttcattgagggtatgatttgtgaaggcggctgtgtaggcggccccagccggcataaagcagctttggctgccaagaaggacagggataaactgatttcccaggcagacggaagaggcgtacatgaaaacctgaaaaattataacatggattctttctccatgcaccgttaggtacattgcaccgttaggtacattgacggtcatataatcccggttatgggacatgaatgatttttgcggaaggagctggtagtttactggctcctttctttatattataatgaatgtacatttactataaagagcctgtaggatccgccgaaggcggttctgtttatggcccggggaatgagggggatttataattgaaaaaagtacagcctgtgcagaacacattttttccggagagaaaacggaagccgccgcagttaaagtggagtatgaccattttaatgctgctatgctggcttttgcctctggcaattctcaccatggctattttaacctatgtgtccaaccgtttttcaggccagatgagggaaaatatagaaaaatccatggatacggctgtggaaatatgtgaaatgagggtggaggccgcggtccgggtttcgagaaatgcttcgtatattcctcagatcaaggaaagctggagacagtaccagagtgacggaaatcgtctgggattatatgaaaaggtcacgacctttctggaacagatgtaccgttatgacagcagttttttgagcacgatcctgtactttacagaagaaccggagcgaatctattacagctacagcagcaataattacagcagcattaaggaattcaggagccaggcaagagacagtgtggatcagaaagcaagggaaatagataccgggataggctgggtgaatgaacagggacatttatatatggtgcgtaatattatgaccccggtatacacgccctatgcggtaattgtcatggatatcgacaaggacagcgtctttcagagcgtggagggagttccctggtatctggattatgatgtcagcatagatgatgagtgggtgttcggcaccggttgggcggaggattttatcagccggcaggatacggaaagaaacagtgtataccatgaagaagatgaagtggcctatgtgacctgtgaacggaaaatggacaatcatgttatccgttatgtggtgaagatggactacgatgccatccattatgagaaggaggccattcggtatatcaccatcctgatgatggcgttcacccttccccttatattcattgtattttatttcctgtacaggaaggttaccacgcctgtccagcgtcttattgacgtggcctcggaaatcgaaaagggacatttcggggtaaaaattgaaaagaaagaaacgagcagggaatttttatatctggacaatgcgttcaacagcatgtcggataagctgaagaatcagtttgaacagatttatctggaggagctggccctgcgggatgcgaatatcatggcgcttcagtcccagataaacccgcatttcctcaataataccctggaaatcatcaactgggaggcgaggatggaagggaatgatcgggtgagcagcatgatcgaggcgctttccaccatgctggaagccacgatggacaggaaaaagcagcagatgataccactgtctgaggaaatcagctatgtggaagcctattgctatataatcagacagcggttcggagagaagttccagtttgaaaagcagattgaccccgagcttctgcagacggaggtaccgaggctgattatccagccgatcatggaaaatgcggtggaacatggcctgtccggccgtgcgggtaagattgtacttcgtatttatgcggaggaagacaagctgaaaatagccataatcaatgacgggctcatgtcaatagaggataaaaggaaagtggatgacctcctgggcagcggggaggacggcggcgagcagcattccgtcagcctgggcatccgcaatgtgaacaagagacttaagattatctatggcccggactgcggcctgacaataaaaaacgacaaagaagaatgtacggtgagcacaataacagtcaaattgcataaatgatttcctggggaacagaacaataaaagacaaataatcacaataggaatcattaacctttacgctggattgttatatgataagtacagatgaaaaacaagtcatccaaaacgaaagggaggtttcttagatgaaaagaaaattattagcttgtgtattggcatgtacgatggcagcttcactggcaggctgcggaagcagcgcaagccagacggcaaatgactccaaacctgcggagtccgtagcggcggaacagagccaggcatcggaggaaagcacaccggcggaggaatctgcggcagaaaccggagaacttgatgtcaagagcggcacaacgctgaatgtgacaactaccttcgcaggcgaagaaagcaacgtacagaattatcaggattctgtgaagagatgggaagaaaaatacggatgtaccgtagcggattcctcaggaacagcagatgaaacctttaagtcccgtgttatctccgactttgaggcaggcgcagaaccggatgtactcttttactttaacggaaatgactccaatccctttgtagaagcgggaaaggtagttaccatagacgaaatccgttccgtatatcctgattatgcatccaacatgaaggacgaaatgattcccgcatgtcctgcagacggcaaacagtatgcagttcccttctatggatactgggaaggtatgtatgtaaataaatccgtatgtgagcaggccggcgtagaagttcccggagcaaataccacatgggatgaattcctggaaatctgccagacaatcaaggatgccggattcacacctattgcagcatccctggcaaaagagccccattactggtttgagttttccatttacaaccatgataccccggctacacatgcatctgtccccgcttccctggatgacgcggcaggaaaggcatgggctgcaggactgggcgatatcaaggatctgtttgaaaaaggctatttctctgaaaatacaaataccgcagaagcttctgaagtattccagagctttatcgacggaaaagcagcattttatgtagatggttcctggaaaatgggcggtattgcggaatcaacggatgacattgataactttaccgtaacctttgttcccggcgcaaatgaccgtaaagcaagcgatatcatcagcggactttcctcaggctggtatattaccaaaaaagcatgggacgatccggaaaaacgtgcggcagccgtatcctttatcactgacatgattaccgatgaaaacgtatccctgttcgcacagactgcagcaacagccctgaaaaacggcgttcagctggatgaagcttctctgaattccctgcagaaagacagtcttgtaatgattaaaacagctaccggtgttaccgatgcggcacaggatctttgcacacaggaacagagagcacctatctttgaccatatgcctgaaatcgtgaccggcagtgtcagcattgaagacgctatttcccaggtacttgagaatatgaacgaataatcggatgatatccggtgtttgcggaactgtcgtaaacatacgcagactattaacagcacaagggccgaaggcttttcctccggccctttcatgaagaaaataatgatggaatgacgtaataataaagctgtaaaaagatttatatcgtcagcgcccggcgaaacgggcagagaggtgttggtatgaacagtcaaccaaatatctataaaaataaaaaacctgtctttttcttccttctcccggctttcctttttctggcgctgtacctgttttacccgtttgtgagaaacatcttaaacagcttccagattatcaaggatttgggagcgcctgcaaaaggatggaatgacccgatatataagaattatgcaaagctgtttacggataagaacatgggaatcgccatgaaaaacacgcttatcatgattgtggtaacgcttttgggccaggtgggaatcgccctgattctttccctcatggtggataatattaagaggggagccaaatttttccgtatcgtttactttttccccatcgtagtatccgctaccgcacttggtcttttgtttaacctgattttcctgtatgacaaaggtatgcttaatcagttcctgggattcttcggggcggataagctgacggactggaaggattcagcccacgcaatggtgacaatgctggttccggtaatgtggcagtatgtaggcttttactttatcatcctgctgacgggacttaacaatatttcagatgaattatatgaatcggcggctattgacggcgccacaacctggcagaaggtgaaatacatatccctgcccctgcttcacaacgttatctgcacctgcagcgtccttgctgttacgggtgcgctgaaggtattcgatttgccctggataatgttgccgaacggcatgcctatgggagaaacatggctgaccggtacctatatgtactattgggccttccagggaaaggatattgactacagctgtacggtggctatcgttatcgtaatactgggaatcctgctttccaaggtcgtgaacatgattttcaaagaaaaagattattaggaaggggtatacaaagatgaaaaagaagaaattttccttaggaatgccgcttgtgtatctgcttcttatagtatgggcattaaccactatctacccactcatctgggtagtgatgaattcctttaaggataagaaacagattgtttccaattcctttgccctgccgtttggcggcctgttcacattggataattatgaaaaggccatcaacaaattcagtatttttacggcttaccggaacagccttatcatttcctgcacggttgcggctgtggttatcctgttcgcaggtctggcatcctatgctctggtccggtataaattcagaggcagcaacctgatgaacagccttgtcattgcggcaatgatgtttcccgtattcgcaaccataatccccgtattccggatggaatccagctgggggattgtaaataccaataatctctggctcgcactgctgtcctgtgcgctgccgcagatagccggtaatctggcttttgccatcgtggtgctttccgggtatatcaagggactgcctgtggagctggaggaagcggcatatatggaaggctgcaatgcataccagattttcttcaaggtgattatgccgctgacgaagccctcctttgccaccgttggtattttcagcttcctgtggagctataacgacctgtttacccagaccttcttcctgcgtttccccaatcactgggcgataaccaggctgctgagtgaaatttcaggaaagcagggtacggattacggtctgatggctgcggcggtttcccttattgtagtaccgttgattgtagtttatgtctgtctgcagaaatacattatcaagggtatgacggcgggagcgattaaaggataaaaaacaaaaacagggaagatgcggaaagtgtttcttaacagaacgctttccgtttttgtgcgtttatgatataatgataaagcgttttggataacaggagaaataaatgccctcggcggggcatatgttcttgtcagggcatatgtcccgccaaagggcatgaacatacagggggatattatgtataaggttgcgattgtggatgatgaaccggtaattgtcaggggacttaccaagatgattccgtgggaaagctataactgccgggtggtagggactgccggggacggacaggagggcatgaagctgattcgggagcagaagccggatatcctgatatcggatatctgtatgccgggcatagacggcctgactatgatcgccggtatgaaatcagaattcggccatatgcagatcaccatactcaccggtttcagggattttgactatgcccagcaggccatccgcctgggcgtgacccgtttccttttaaagccttctaagatggatgagctggaggaagcagtccgggttatgatcgagaacctggaaaagcaggggatcacaggaaaagaagacggggcggatgagggggttggtgagaatgccctgaacgcggaaggaaaaccggagggagaagaaggaaaagagaaagcggagccttcggaagggaaagaaggagaggagacagacagcccggccagctgctttatcgtaaagaacgccctggcatacatagaggaaaattacagggagaagctgaagctttcggatgtggcggatcagatttacgtgagccagtggcatctgagcaagctgctgaacaagcataccggccagaatttttctgaaatcctcaatactatccggattgaaaaggcaaaggaactgctgaaggatccttccctgcgtatcggcgatatcgcggaggaggtcgggtttctggatgtggcccatttttccagggtatttaaaaagcaggcagggatatccgccaatgaataccggaatacaaagctgggaagctgaaataaggcagggcttttatacattataataaaaagaagaggaacagcggcatttggtatgcgccgttcctcttccttttatggaatatgcggatggctcacagggcgtggcctccgttgtttatagctttgccgatcataaattggcagaaggaatccgttcaggagcatttaggatttccataaattcatctccggtaatggtttccctttcatacaggaattttgccagctcatgcagcttcccgatgttggtgttcaggatatcgcaggccttggcatgttctttttttaccattcccactacaagacggtcgatttgcgcggcagtctgttcggaacaggcaagggaggtgtcgccgcccagatactggttggtaacggtctccagggctaccatgtcaaagtcctcagacattccgtagcgggtgatgcaggctctggcaagcttggtggcctgctcgatatcgttgcttgccccggtggtgatgctgtggaatataatctcctctgcagcacggccgccgcagaaggtagctattttgttctccagttcttccttgctgagcaggtattgatcaccctgatccacctgcatggtataacctaaggctccggaagtacgggggataatggttattttggtaacaggcgccgaattggtctgctttgcagcaaccagcgcatggccgatttcgtggtaagaaacaatcattttttccttgtcgctgagcaggcggtctttcttctggtaacctgcgataacaacctccacgctttcttccaaatccgtctgggtcacaaatttacgtccggagcggacggcatttaaggcggcctcgtttaccatgttggcaagctctgctccggatgcgcctgcggccatcctggcaattgccttgaaatccacattatcgcccagcttcactttctgggcatgaaccttcaggatggaaatacggccgttcaaatcaggcagctccaccgggacacgccggtcgaaacggcccggacgcagcaatgcgggatccagggattccggacggttggttgcggccaggatcaggacgccgttgttgctggaaaagccatccatttccgtgagcagctgattcagagtctgttcccgctcgtcattgcctgaaaatccgccgccgtcacgtttcttgccgatggtatcgatttcatcgataaatacgatacagggagccttttcgttggcctgcttgaagagatcccttaccttggctgctccggcgcctacgaacatttccacgaactccgaaccggaaatagaaaagaagggaacattggcttctccggccactgccttggcaagcagggttttacctgttccgggagggcctaccaataaggcgcctttaggcatggaagcgccgatttcctggtattttttaggatcatggagatagtcaaccagctcggagagcacttccttggcttcatcctcaccggcgacatcatcgaatttaatgccggtttccgactggacataaaccttggcgttgcttttgccaaaggtcatggaatccatgcctccgccgcctttcatcatcttgcgcattgcaaactggccgatggcaaccatgacgataatgggcaggatccaggtcagaaggaaagtgaccaggaagggctgctgttttacaatttccgtgccgaaggttgccccggatgcataaagacggtctaccagggcaggatcttccatggggccggtcttatagaaaccggtaggtgaatttttatctgagaaaatgatctggctgctttcaatctgaacctgtgcgatctgctgtttctccatcatttccatgaaggtattatatccgacttcttccacctgggccgacatcagcctggggaaaagaaaagcgttcaggaccagaaggacgagcattgcgatacaataataataaagtaatggttttttaggtggtttcacttcttgcatagtatttccgctcctttttcggctggtatgatccgtataaaacaattatatatactaattttgagggaagtcaacaagagtcatcattatttcacattatttatctttttttcataaccatggaattatgttccggttttccggggatatctgataagtaaacaggtgtgtccgcaggcaggggctgccccgtacaataaaataaattgtgccggggcagcgggacataagtattgtatcatgtcgtttttatacaataccggatgagacttcggctttataattagaaatggagcagaaaggtatgtcttccttgtttggtatcacatcatacaataaaaaatgccggggggggggtgataatatatactataagatttggcggcccctgtctgggcctccgctcagtaccggggtttggggttcgcaacttcaagctgcataaaagcaaacaggggttggtagataaatcagcaatgaaaatctatactgtaaccataaaatatgaaaggagcagtattttatgagttttgcagaaaatttgaagcaaataagaaaagaaaaagggttttcacaggaagagttagcggaaataatgaatgtcagcagacaagctgtttctaaatgggagcaggggatcggatatcctgaggttgaaaagctattgcttctttcaagtaaattaaatatttctttggacagtcttatgtctgcggaaattgcccaaaataacaattcggaaaatcaaaaagttacaggaacaatcatgatatcatctccaaatgaaaatgtgatagcaacgtgctacaaggttatgtcctcagggaaaatgaagggcggaaagaagtctccgcaatacgctttgtttggtgtcagcaatggaagctcatcgttctggggagagccgaccatttttttgggatggtatgccagccatgaattactttcaaaagaagtcagcgaaatacaaaaagctatcatacagggaattcctgcgtacgaattgaaatacaatgcaaaagtcgaaagaaaatggttaagaatgacaatgatagatgagtgatacaaatataaatttacagtacctgcatcgtcagacggaaaggaatattttatgaattataataaagccagaagttttgtttacaagaatgcgaggccattggaccttgcccgatggaaatatctgtttgaagggggcagcaaagaagatgtgttaactgcattggcggcatatcaaaatgaagatggcggctttggccatgccctggagcctgactgctggaatccggattcttcaccgatccagacatgggtcgccacggaaatcatcaaagaggttggattggaggaaaaggatcatcctattattcagggaatccttcaatatttagcttccgaaaaggattttgacggccatacctgggccaacaccattgcttccaataataacgttcctcatgccccatggtgggattatgatcctgctgcggaagcatcttataatccaaccgcaagtctgattacgtttattttgaaatttgcggatcgggaaagcgggctctttaccttagcacgtacccttacaaaggaggcttacagctattttaaggcgcatttcccgatggagtctgtgggaaatgtttcctgctttgtaaagctttatgagtatttgaaggaaaactctgcagatacgttgatagatttaacggaattcaaagccctgcttcagcagcaaatacggcatgtcattacttatgacacctccatatgggccactgaatatgtatgtaagccgtcaattttaatcggctcgaaggcaagcgatttctatgcggagaatcaggaaatatgtgcgtatgagtgtgaatttatagaaaatacccagaaaccggatggaacctgggcgattacctggtcgtgggaggattatgattatccggaggagtggagtatcagtaagaactggtggaaatctgactggattattaaatatattcgttatttaaaaacaattcgttagccttaactgaataaatgaaagaataaaaggtcaaatcaaagcggtttgactttttatttgattggaattagactgattatagaaggtttttgttggtataattaatatacacggaaagaatagatggagatagggaatgaaacaaattaagttgattgtactggtatttgttttaatggtttcacttaccggctgtaacaatgaaaaagcagggaatgaaaagaatggggaaacgagtgtgaatgaagcatcagaagagagggacccggctgaggtcattacgtttcctacatatgaagaggcaaatccggaaaggctgccttttattgataaggtaaataatactccggcttttcatgtgaaggtgaatttgcctgaaaactgggtggtggaaaacagaaagcctgatgttgaaaatttggttcccggtgatttttattctatgctttttatttatgaaaaggacaccttaatcggatatataggttttaatatatttgatccttatgaagatccgattcctgaggaacaatattatcagacggtttatccgggactgcggctgtcatcagtttttcactgggatccctatgaggcagtaaaaactacagatacggcggaaacagggattgcggatatatggtatctggaaccgggagaaatcgataagcatccgggggcgatggcggatgtgccgcagcaggaaacgataggtattttatcctatgataaggaattgaaggtatttatcggcatggcattcatgcccgggactgtgagccgtgagcaggcggaggctgttgcgcaaagcatcagtctgtcggcggaagagtgatactaataggtaaaaaggatttttaatcttccttttatgccgtcgtagacaggaacggcggcggatacaggaacaaaaagtactttacatcctgcatgaagtagactaaaatacaactatgtaacgtatttttgcgttggaattggaaaccaaaaggacaatcagggtggaaacgcgagtattcgtcccttatatcccagccggactggataagatatggggggcgttttttttagccgaagcctgaaatggggtatagcggaagcagaatcctcctgattaagaaaggagtgttatatgcgcaaagttaacgatttggattgggaagaaatcaaaaatataacagcggaaggcggccggaaggttaaagaaaaaatgactgcggagagcaaactcagcaatatgaaccttgggcttttgctgggcgttacttttttgctcggaattgtcatcggatttatatgggcgccgatcaagagaggtctgtatattgcgggtgcggatataaatctgggagaaaaagataaagaaaagatacaggacgagggagaaaacaaagagaaatgaaaatcacattaaaagacggatcctttaaggagtatgaggaaggcagaagtattattgagattgcaggggatatcagcgaagggcttgcacgggcggcctgcgccggactggttaacgggaaggtggaggatctgcgtacggtgctgacagaggactgcgagctttccatcctgacagcgagagacaaggaagggcttaccgttgtgcgccatacggcatcccatgtgctggcacaggctatgaagcatgtctttccggaagcgaagctggcgatagggcccagcattgaaaacggcttctattatgattttgagcacgagcctttttccagggaggatctggataagctggaagccgagatgaagaaaatcatcaaaaaaggggaaaagctggagcgcttcactcttcccaggcaggaagccatcgcttttatggaagaaaaaggagagccttataaggtggagctgatccgggatcttccggaggatgcggaaatttctttttacagccagggtgatttcacggatttatgtgcgggacctcatttgatgagcacgaaagggatcaaggctttcaagctcacctcttcctcaggcgcatactggagaggggattccaaccgggccatgctgcagaggatttacggaactgcttttaatacgaaggaagagctggcagagtatctggaatacctggataatatcaagaaccgtgatcataataagctgggacgggatatggaactgtttgcaaccgttgatgttatcggacaggggcttccgctgctgatgccaaaaggggctaaaatcattcagacgctgcagcgctggattgaggatgaagaagaaaaaagaggctatatgaggacaaaaactcctctgatggctaaaaaagatctgtatattatttctgatcactggaatcattataaggaaggcatgttcgtccttggggatgaggaaaaggatgatgagattttcgcccttcgtcctatgacatgtccgttccagtattatgtgtataagcagagccagaaatcctaccgggatctgccctgccgttatggagagacatccactttgttcagaaacgaggactccggggaaatgcacggactcaccagagtgcgccagtttaccatttccgaaggccatctgatcgtaaggccggatcagatcgaagaggaattccgcggctgtgtggatctggcaaaatattgtctgacgactctcgggctggaggaggatgtgacctaccgtctttccaaatgggatcccaacaataaagagaaatatcttggggatgaggaaacctggaattacgtgcaggacatgatgcgtgatatcctgaaccatatcggcattgaatttaccgaagaagacggcgaggcggctttctatggccctaagctggatatccaggctaaaaacgtatacggcaaggaagatacgatgatcacgatccagctggatatgttcctggctgaacggtttgatatgacctatattgatgcggacggggagaaaaagcgcccttatatcatccacaggacatccatcggctgctatgaaagaacactggcctggctgattgaaaagcatgaaggcaagttccccacctggctgtgtccggaacaggtgcgtgtgcttcctatttctgagaaatacgaggaatatgcacagaaggtgaatgcagcgctgaaggataacggtatcctgagcacggtggacagccgttctgaaaagatcggatacaaaatccgtcaggcgagactggataagcttccttacatgctggttgtggggcagaaggaagaagaggacggtacggtatcggtaaggagccgctttgcaggggacgagggtgtgaaggccctggatgagttcatcgactgcatatgcaaagaaatcagaacgaaggaaatccgtaaggttacggttacggaggatggccagcaggcgaaatagtgccggtccatcggacgcctgtatcacggagacggacagatgaagaataaagaaaaaacaacatggctgcagacggcggggatcctgctgtttgcagctgcctgcacaatggcattatacagcctgtatctgtgttttggcagcgatatatggtatgacgagctttttacggaaggctttatcagccagccggtggggcgcatgatttcccttgcggtgaaggatgtgcatccgccgctttattatcttctggtaaaaatagcggtggatttctgccgcttttttgtgccttccgcgaatgcggtgattataagcaaggtcgtatcggtactgccttatctggggctgctggggtattcccttgtcttcttacgcagacggtatggctggctgtgcgccgggctattttccttctgtatctttgccatgccgcagatggccaactatactacggaagtgagaatgtacggtttcgcgttgttttttatcacggcggctttctttcatgcgggggcgatcctggaaaacggcgggaaaaggaactggatcgcattgacggtctttgggatctgcgccgcctatacccattacttcgccgcagtatccgctgcggtgctgtatgtgggtcttgcggtgctgctgtatgtaaggaaaaaagataccaggacgaaaagcctgctgacctggcttttgtgcgtgggtatttctgtcctggcttatctgctgtggcttcctgacgcggtggggcaggtgtcccaggtacgggagaattattggattctgccccttaccttaagctgcttcggaggctgcgtgaagtttgtattgaagccttccaccggttaccagtggccggattacgtgctggctgtactcctttttctcctgctggcgggattgctggcagcggcttttttcaaaagaaaagaggatgaaaaaaaggccggcgaggatgtgtatgccttttttggcctgtgtatccttgcaggaacagcccttttcggcattgcggtatcttttctcatgcgtccggtgttcatttaccggtatatgctgccttccatgggctgcttctggttcggctttgtttctttactgagcaggcagaagaaaaaaagggtgctggttccggcgctggttctgctctgtctggtcggggccgcggactattctgcttttgcaaaaggagaatttttaaaaaaggaacagatggacaggacactggaggagctttcccggataggggaagaggatgcggtggtttttaattttgaccaggtccaggcggttgcgggctactatatgaatcaggaaagctggctgtatgggaacgagccggagtctttgataaaagaaatgttcccggatatccatggcatacaggatatggaagggatccggcagaagcttcaggaaggccagcgggtgtggtttataggcagcgggctgatccgggaggatattctgaaggaatgggccaaagagggtatcctttcggtggaaacggcggacagctgcctgctggagcgttattggtttaatatttaccgtctggagctgggcgggatgacaggaacggcggagcggacaataagccggatgaaggattaacatgaatattttcctgaaaatcagacagaataattctggaaccatctaacagggtttagtttgaattgatttcaggaggcaagcagaaatggcagaattaaaatgcggagtaaacaattgtacctacaataatgacagatgttgctgcaaaggtgatatcatggttggcggcaaaagcgcacagcaggaggatgatacctgctgcgacagctttaagcagagaagcggggacagcacatccaattccatgaatccctgcaggactatcagcattgactgtgaagcggtaaaatgtgtattcaacacaaattacaaatgctatgcggagcatgttgatataaagggatgcggagcatgtgactgcagagaaacagcatgtgcaacctttaaagaaaaataagaatataatatgaagccgataccggcttcaggaagcggcggaaaagtctggaatgatacagatttttccgccgctttttctgttgtcatgaatttgattgataaaactgccgataaatatagtgtaaaaatgttgtatttgcagcaagtggcattaaaaaaatagaattttcaatgaaaatcaaaaaatattctatataatatcgggtaaatattgtataaactatcgatattgacaaacgacaaggaaacgtgtcaaacagaagggagaaaaatatgaagagaaaattaggttgtatggcaatggcagcagtgctgagtctttccctggccgcatgcggctccggtgagaagcctgcagtgacagagtcaccggctgcgggggcggagacgacggcggcaggaacggaaacacctgctccggcagaagcggcgccggccgatggaggaactgtggcgaacaaggataaaccgctggtatggtttaaccgtcagccctcaagcagcgcaacggggcagcttgacatgacggcactgaattataacaaggatacatattatgtaggttttgacgccaaccagggcgcggaactccagggaactatggtaaaagattatatcgagcagaacatagactctattgaccgcaatggcgacggcatcatcggttatgtgctggccatcggtgatatcggccataacgattccatcgcacgtacaagaggtgtccgcaaggcactcggcacaggaattgagaaggacggaaacatcaacagcgagccggtgggaaccaatacggacggcacggcatcggccgtacaggacggaacccttgaagtaaacggaaagcagtatatcgtccgtgagctggcttcccaggaaatgaagaattccgcaggcgctacatgggatgcggccacagccggaaatggcattggaacatggtcctcctccttcggcgatcagattgatattgttgtttccaataacgacggtatgggaatgtcaatgtttaacgcatggtccaaggataacgaagttcctacctttggctatgatgcaaacagtgatgcagttgcagccatcgcagaaggctacggcggaaccatcagccagcatgcggacgtacaggcatatctgacacttcgtgttctgcgcaacgcccttgacggagttgatatcaacacaggtatcgccaccgcggatgcggcgggaaatgtcctgagcgaagacgtatatgtgtacagagaagaagaacgttcctattatgcactgaatgttgccgttacttctgacaactacaaggattttatggattccacaatggtttatgcgccggtatccaatcagctggatgagagcacaagcccagcaaagaaggtatggctggatatctacaattcatccgataacttcctgggctccacctatcagccgcttcttcagaagtatgataagctcctcaaccttgatgttgactacatcggcggcgacggacagacagagtccaatattaccaaccgtctgggcaaccccagccagtatgatgcatttgcaatcaacatggttaagacggacaacgcagcgtcttatacaaccctgctcgatcagtaatttttgttgatacgaaagccgggcaggttattagggagaagaaattctccctaataacctcttttgggaagcaggcgttttaatagcagaggagtaaaaattatggcagataagaaagatgatatcgtcttatcaatacgcggcatgagcaaatcctttggccggaacagagttctggaccgtatcagcatggatgtaaagagcggaaccgtcatgggccttatgggtgaaaacggagccggtaagtcaaccatgatgaagtgccttttcggtacatatcagaaggatgagggtacgattttcctgaatggtaaggaggtgagcttttccggccccaaggatgcgctggaaaacggaattgccatggtccaccaggagctgaatcagtgcctggaacggaatgtggtggataatctgttcctcgggcggtatcctgtgaattccatgggaatcgtcgatgaaggcagaatgaaaaaggaagcctctgatctattcagaaagctgggcatgacggtcaacctgacccagcccatgcggaatatgtctgtatcacagaggcagatgtgtgaaatagccaaggctatttcctataattccagagtgatcgttcttgatgaacccacatcctctctgacggtacaggaggttgataagctctttgagatgatgaggatgttgaaaaaacagggaatcgccctgatttatatctctcataagatggatgagatatttgaaatctgtgatgagatatcggtgctccgggacggaaacctggtcatgacaaagagcaccagtgatgcgaacatgaatgagctgattgctgccatggtaggccgttcccttgataatcggttccctccggtggacaacgttcccaagggtgtgattttatccatccagaatctgtctacgaaatttgagcctcatctgcaggatgtctcctttgatgtaagggaaggggagatcttcgggctgtacggcctggtgggagcggggaggacggagcttctggaaacaatcttcggcgtccgcaccagagcggcagggcgggtatactttaacaaccgcctcatgaattttaacagtgcaagggaggccatggagcatggcttcgccatgattaccgaagaacgtaaggccaacgggcttttcctgaagggcgatcttacctttaataccacgatcgccaatctggaacagtataagaccggtgtggcgctttctgacgcaaagatgataaaggccaccggaaatgaaatcaaaatcatgcataccaaatgtatgggaccggatgatatgatttcaagcctttccggcggcaatcagcagaaggttatctttggaaaatggctggagcgcggaccccgggtattcatgatggatgaacctacaagaggaattgatgtgggtgcaaaatacgaaatatatgaactgatcatcaatatggcgaagcagggaaagacgattatcgttgtttcttctgaaatgccggaaattctgggaattaccaaccgtattggtgttatgtcaaacggccgtctatccgggattgtcaatacaaaagagacaaaccaggaggagctgttgagactcagtgctaaatacctataatgggggagattgtgatatggataatgaaaatagtaaaacccttacggcggaacaggaaatgcagctgcgtaagccaattgaggattatgtgggtgaaattcaggaaaagattgacagtctcagagaggatggggcaaataaggtaatttctcttcaaagcgaaatagacggagtgaagagggaccatggcctttcgaaggaagagaaggcgtcgaggactgcacagcttaaggcttccatggataaagcgaaagcggtggaagcgaagaataaggaagaggtttccaagctgatttcgaaggcggagtcttatctgaacgagcattttgtcaaggactactaccatgcggtgaaacagagctgtgcacaggaaaaaatgcttgtaaagagaaaaaatgcggataatatggcactgctggagcaggagcataaaaagacacttgcgaagcttaccgatcgcaaggaaataaagaacgaaaagtatgtgtataagaaccgccgctttgatgcgaaaatggaactggaaaaggaactggcgcagataaaggacagaaggcatgcggcgcttgtctggaaatttcatctgatcgatatgctgcgtatatctaaatttacgtttatgcagacaagggcgcagaaatgggaaaattataaatacacctttaaccgcaggacatttctgctgcagaatggtctgtatatagcgattatcctgatttttatcgggctgtgtatagcaactcccattgtaaagcatgttccgctgctgacttataacaatattttaaatattctgcagcaggcatctccgagaatgtttctcgcccttggcgttgcaggcctgattctccttaccggcacggatctttccatcgggcgtatggtcggtatgggcatgacgacggcaaccatcatcatgcatcagggaatcaacacaggtgcggttttcggacatgtatttgactttacgggcatgcctatcggcttacgagtgatttttgccctgttaatgtgtattctcctgtgcacattctttacagccatcggcggtttcttcacagccaaatttaaaatgcatccttttatctccacgatgtcaaacatgctggtgattttcggtctcgttacctatgctacgaaaggggtgtccttcggcgccatagagccgtcgattcccaaaatgattatccccaggctaaatggcttccctacaattattctctgggcggtagcagccatcgtcatcgtatggtttatctggaataaaaccacctttggtaaaaatctgtacgcggtgggaggaaatccggaggcggcatctgtttcaggtatatccgtatttgccgtaaccatgggggcattcatcctggcaggtattctctacggcttcggctcatggcttgagtgtgcaagaatggtaggctccggttccgcagcctatgggcagggctgggaaatggatgcaatcgcggcctgtgtggtcggcggcgtatcctttaccggcggtatcggaaagatttcgggcgtggtagtcggtgtattgattttcaccgtgctcatttattcccttaccatccttggcattgatacaaaccttcagttcgtatttgaaggcattatcatcattactgcagtaacccttgactgtctgaagtatgttcagaaaaaatagtggtttatgccgcaaaaaaagagtcagaaggccttctggctcttttcgtggtggtggggttcccggcgccctgtgcgtctgccatcgtttccgtccggctgccctcccccgttccctcctgcgggcggcggctctgcaaggttcctgtgcgggtgcgctttcgctcggataaacacgcagcggtactaaggctgcagaggacgcagcctaaggaccggcgtgtttatacgacccttacaggaatccttgcagagccgccgcccgcaggagggaacgggggagggcagccggacggaaacgatggcagacgcacagggcgccgggaacaggtaggctgtgtagggcgggagagcagggcgtgggaagcggatcgggaagagcgggggagaagtgagagggcggcttgctgatgtgagggtacgatatatggggtgtacatttacatagctttgggcatttgttataattaggataatggaaagcggagcccggattgatgaatggagaataggtatggatacatatacggtgcttctggtggatgatgaggaagaggtgcttcaggccatcaggaggaaaattaattgggaagggctgggcttctctgtgatcggatttgccaataatggcgttaaggcgctggaaatggtagaggaatttcagccggatgtggttttgacggatattaagatgccctatatggatggtatggagctggcgaagaatataaaggcggaatttaccacgaccaagattttgttccttacgggttttgatgagtttgaatatgcgaaggaggccgttcatctggaggtggaggaatatattctgaagccggttaattcaacggagctcattaatgtattcacgcagctgaaaataaagctggatcaggaaatcagtgaaaaacggaatgtggcggtgctgcagaaatattatatggagtctctgccgtttctgcaggctaatttttattctatcctgatcgaaggaaggctgcgggaggaggagatttccaggtatctttccgattatcaggtttcttttgaagggccattttactgctgtcttgtggttcacacttcatccagccgggtgccggagaatatgaatcctctgcttctggcggcgtctgtccagaggcaggcaagggagcatctgggagagaagtggcaggcgaaatgtttttcctatcttgagaatacggttttgatcgcacagctgaagagtgaaaatgaggttccggagctgacggatgaatgtgacaggttctgcaggtatgcccagcgtatcatcggcgctgttgtcactgtgggaatcggacaggtctgtgggcggcttaccggtctggcccagtcctacagcagtgcgagggaggctgtttcttaccgggttatctacggcgtttccagggccattaacatgaaggagattgcgccgaaggaaatgagcaaatccgacgggactctcgatgcggagctgcttaacctgttcggcatgatccggctgaattccgacgaggatattatcaaagcggccagacggtatctgaaccatatatcctatccggccaaatccctgcagcagtatcatattgatcttatggatctgataagcgcgctgtaccggttcgctgtcaataatgatattgaggttccggattttacggggaatatcagaaatctgtatatacggattctggatctggagccggaggcactggagaaatggctcattgatatctgccttttgctccgggaaaccttgatcagtgcaagaagcaaatcaacgcagtcctttgtattccaggcaaaagaatatgtggcaagccattattcggacgaagaaatttctctggataatatctgtgagatgctgggtgtttccaattcttacttttcaactgtttttaaaaaggagacggggaactcttttatcggctatctgacggaataccgtatggaacgggcatcacggatgctgattgaaacaaatgaaaaaagctatataatagcgaagaacgttggttataccgatcccaattatttcagctatgtatttaagaggcggttcggtgtatccccttccaaatacagaatggagcacggctcatgtgaaaaataaatatttccgtaaatttaaaattttcaggcccagagggatacagtctacgatcatgctggtgttttccgtcatatccatttcgatcatgctgatcctgggcattgtgatgtacagcaggttttccgccctgtcccgggaaaatacaatacacagtacggaaaagctgatggagcaggccggggaaaatctggaggattatctggtaagcatgcggcagatttcggatgcggtttattataatgtcataaaagagaatgatttctcttatcagagtgatgccattcagagaggaatggatcttctgtatgaagccaataaaagcaatctgcgcagcattgccatatataacgggagcgggagcctgattgcggcggagccggttgcgcgccagaaggaggatccggatgtcaccaggcaggactggtatatacaggctatgggtaaaatggagaatatgcatttttccactcctcatatccagaatctgttcgatgacggtaccttacgttattactgggtgatttcactgagccggtttgcggaattttccgatcacggggaaccgcagacaggggttctgcttgtggatatggattatttcagcatctcccgtatgatgaaacagatcaatgcattaaataacgggcagtattactatctgtgtgacagcaacgggcagattatctatcatccgcgccagattcagataagcgacgggatcgcaagtgaaaacagtgcggtcgccgcaaagtacagagacggtgtctgtgatgaaacctttgaaggggagcacaggacggtgattgtaaataccataagctataccggctggaagcttgtgggggtgattcctgattccacattcactcatggaatgattaatgtccggtattttattgttatgctcatgctgctgatggtaattacgctggtcattatttaccgtgtggtttcggtaaggatatccagccctatctgcaggctgaatgattcggttatgggatatgaggcggggggaaagccggagatttatatcggcggttcctcggaaatcaggtatctgggacattcgattcaaagctcttatgaaaagattgaagttcttatgaaggagattgtccaggagcagaatgaaagaagaagaagtgaactggatgcgctgcagagccagatcaatccccactttttatacaatacgctggattccattacgtggatggtggaaggcggacgcaatgacgaggccgtattcatgatttcccagctggcaaagcttttccggatcagcctgtcccagggacgaacggtgatcagtgtgaaggatgaactgcagcatgcggaaagctatatgaacatacagaaggtacggtataaaaattcattttccgttgtatttgacgtagagcctgatatctgttcctattgtacggtaaagctggttttgcagccaatccttgaaaacgctatcaattatggggtcagcggtatggatgactgcggggaaataaaggtgacagggagactcagggaaggcagtattgttctttcggtggaagataacggaatcgggatgtcggaggaagaggtgcgcttcctgcttacggacagcagcagagtacgtaagcatggttccggggttggccttgtgaatgtaaacaaccgggttcagattcttttcggaaaggaatttgggctccgggtggaaagtgagccggacgaggggaccactgtctccgtctttcttcccgcagtgccgtatacggaggaaaacaggaagattctggagatgggacatatattcaaccgggaggaaatgaataacaaagatacgtagagtaattgcggctgtgaggggacagggcagttacgagtaagtttaaaatacgttctggggcaggtggagatgaagaacaacaaaaaaatgttttttcttacggaaacccttttggcagtcatggtgattgccgtggcttttattatggtgcgggagaggaacggaaaggaacaggataagatttccgtgataatccaggattcggaggacacccaatgggctgcctttcaatacgggctgaaaatggcggcggaggatatggatgtcaggatgtttattgtcagtaccggcagcacgttaactgtggaagaggaaaagagcctgatagaaagggaaattgataacggggcggatgcggtcatcgtgcagcctgttccgggatcggaagaaatgctgtggaaaatgggaaaccgggttcccgtgatgctgatagggaatgcggcgtctgaagaaggggaggaatccctgcttccggtggtgggaccggataattatgccctgggagctgctttggcggaggagctcctgaaggattataacggaaatctgagcggaaagactctgggcatattttccaaaacaggggattcacgcgcgtccatcgaacggagaagaggatttacggatgccatggaacatacggatgccagcatcagctggtctgcagcggctcccttttcggaagagggagaagctcttttggacagccagtctgctgtagatttagtaattgccctggatgacaacagccttaccatggcgggtgaatatgccgctgcgaataatctgcacggtgcgctggtgtatgggatcgggaattccacggaagcggtttattaccttgatacgggcattgtgggctgcctggtggtgcccgatgagtttaatgtaggctaccagagcctgaaagaggcggcggagagcctcacacattatctgcacaaaatgcaggatcggacggtttcctataacgttatccgaagagataacctgttttccagggaaaatcaggaaattatttttacaatgagccagtagaatggcagggtaaaacgagggggtatcatgaagggaaaaaaatatacggcaggaatgctcgtcctgtcaggagcgcttcttcttgccgcctgcggtaagcagccggccgcgcctgataaggtctatgtgggagtggcaagttacgatggcggcgacgtgtttatcggggaattgattgactgtctcaaagaacagctgaatggatattcgggggacggaatggagacaacggtgacggtccgggatgcggcaggctcccagcgcacccagaacgatcaggtgaaggcgctgatagatgaggggagcaatgtattgtgcatcaatctggtggatcgggccgacccctcggagatcattgatctggcaagggaaaatgatgtgcctgtcatattttttaacagggaacctgttgcagaggatatgatgcagtgggaaaagctttattatgtaggtgcggatgcgaaacagtcgggggtgatgcagggtgagctggcggcggagctgatacattcggacagccgggtggaccgcaacagggacgggaagattcagtatgtggtgctggaaggagagccggggcatcaggattccattatccggacggaaaatgcggtggatacgctgaaaaataatggaattgagcttgaaaagctgagttacggtatcgccaactggaaccgtgcacaggcccagaatcggatgatgcagatgatcggccagcattccaatgaaattgagcttgttctggcgaataatgacgatatggctctgggagccattgacgcttatgcgaagctgaatattacggaatccgtcctgcctgtgttttttgggatagacggcacggatgcggggctgaaggccgtcctggagtctaaattgtcgggaaccgtgtataatgataaggaagggcaggctgcggcaatggcaaagctggcggtttcgcttgtttcaggggaaggcctggaggaaatcgagtttgagaacggaaaatatatttatcttccctattataaagtcacaatggataatgcggaggctttcctgaataattccggcaattgagcagcctgcttgcagtcaggtgaatctacagtgtaattacttatttgacatgtagttttaaacatgaaattcagaaaattcagtttcagaaaattcaaaacatgaaattcaaaacatgaaattcggaaaatgtgttgacatgaccgggtggatatgttagagtattcaagtacgtgagtacattacatgcaagcagagtatccactctcaccctatagcaatcgggctcataggtgttcataggttcagtaaaccggcaggaaactgcatggatttagggaatttaggtggatagtctgactatccactttttttggatgtcaggatgtaccgcatggcgcggcatccgcagattaggcggcagggaagtccggccgcaggcagtttatttatcttttaattgaggacgcacggaaagtgcggatccgtttgtttcttaggagggcaaaacaattagcgaattattaattaacgaacagatcagagacagggagatacgtttgataggagaggatggctctcagcttggcgtcatgtcttctaaggatgctatgaagatagcggaagaagcaggccttgatttggttaagatcgcgcctacggcaaagccgcccgtatgtagaatagtggattacgggaaatacagatatgagcttgcccgtaaggaaaaggaagcaaagaaaaaacagaggacaatcgagattaaggaaatccgtatgtctcccaatatcgatacgaatgatatgaacaccaaggttattgcggcgaagaagttcatcaccaaaggaaacaaggtaaaggttaccctgcgtttccgcggacgtgagatggctcatatgtccaagagtaaacatattctggatgattttgcccagatgctggcagatgtggcagtagtggaaaaggctcccaaggtggaaggacgtactatgaccatgtttttaactgaaaagcgttaatacgtacagttaaaatagattttcaggataatgagtataggaggattttgttatgcccaaaatgaagacaagcagatcagctgcaaaacgttttaaagttaccggaaccggtaaattaaaaagatccaaagcttacaagagccatatcttaacgaagaaatccacaaagagaaaaagaaatctcagaaagccggctattacggatgcaaccaatgttaagaatatgaagaagatattaccgtatttataagtcgtaaggaggaaaattaagagatggcaagaattaaaggcggcatgaatgccagaagaaaacataacaaggtattaaaacttgcgaaaggttacagaggagctagatccaaacagtacagagtagcaaagcagtctgttatgagagctcttacctcttcttacgcaggacgtaaagagagaaagcgtcagttcagacagctgtggatcgcacgtatcaatgcagcggcaagaatgaatggtttatcttacagcaaatttatgtatggcctgaagctggctggtatcgatatgaacagaaagatgctggcagaaatggctgttaatgatgcagaaggattcacaactcttgcagaagtggctaaatccaaaattgcataagacagaaaacgtatttttgcagatttgttattaaggctccgggtaaaccggagtctttttgcttgtaggataggctgctgtgtgctataataacaaaagcggacaggcattcacgaaatgccgcaggccagtactaattgaatggatatggaggatgtcgatagatggaaatattgcttttgatgggcggtatgttattgattattattgttgcagtagttgttgcggcggtttcttccgttgtttcggccgttgcggcaagtgaagaggatgacgaagactgattttgaaactgtgacagggcggccaatactggccgccctgtttttcttggacgatgacggtcagaagagcctggccgacgctgcttgttcaggagtcctttccgattgtaaaggaatttttgtaaattgtaataaaggttaaaagaaattttccgcagacaattgcaataatggctcctatgagaatccccgctgtcatagtaacacctctttctttataacgtcttttttcttatacctgaattatagcacttattataaaaaaaggatggtttttaaggttaagatagtgctaaaaagcttttgatgcatcgggtttccttcgcacaggaactgtcttcaggggtaaaggcgccgggaaggaaaacgcgggaaaaaagccggcaggggtggaaaaagggttgatggacggaaaatcatctgttataatgaattcatgtttcagaaggaggtgtgtggatgtcgtctgttcgataaaatgggagacaataaaatcagagactctcaggtcatgagggctttttgttgtacttattttgcggatggatgaattcaggacgctgtttgggaaaacggcgggcttctttttgattatcgcttatagtaggcagaaactctgaatggcaggggtttctgcttttttttgtccggtaaaattaagaaaacggaatattttaagtcaaaaatagaaaaaggagaaaattttcatgaagaaatcaagtctttccggtgtgttttgttatgcgtagcaaaggctgtcgtgtaacattttcagaagaataaaaatgatacttgtatagcctttgctcattcctgacaaaacaaaaaggagagagcatgatgagctataaaaaagcggcagatgtactgccggaagaattaatagatttgatacagaactatgtggacggagaatatctttatattccgcggaaggaaatgaaccggaaggcctggggggaaaacaccgacagaaaaaaggaaacccaggtgagaaacagggaaatataccgcagatacagggaaggagtgccggtttcccatctgtctgaggattattatctttctccgaagagtattcagaagattatcgcccggtgtcgggagggttccgcatgatggaagataaggggacagctctgtgggctgtcccctgtctgatggactataattttttcaaggcggctataaatttgcctgatactccctgtgagagccgccttttcttttcagaaatatcaaatcggttgcggagaagtaaagccggtacctataataacctcataaagcaacggtttgacagcagagaggatgtattttcatgaaaaggaaaaagaataaagcggaatgggggaaccttgagggacaaaaagagcggcagcaggggcttgttgcccggatcgggaatagacaggctctggtgctgctggaaggaaaggaaattgtgtgcatgctccccggcggtgataacggcctggaaacggcagtaggtgatcgggtgattatagaacagatatcggcacagcagtatcgtctgattgaaatcctgccccgcagtacggaattataccgcggaaaccgaaggcaggggaacagaagagaaggaaaacagcagcagggaggcagagatgaaatcaggattgcggtcaatgcagattgccttgttgccgtagtgagtgcggattatcttcttcatcaggccggatatctggaaatggcggctgcggcggcgagacgggccggtatggaggcaggcttttttatcagtaaatgggatctggtgaaggagagcgctcaggatcttttatatgagaaactggatatttacagaaagacgggggattttgtatatgtgggatccgcacgggaaccacaggaggagctgattcatgctgtaaagggaaaaagcgtggtgatagccggtgacagaggctgcggaaagacaacgctgatccggggaatactgcaggcgtcagatggtatagaagggatggaaggccctgcgggcggaacgactgccgcgcatctgtatgcggggacagatgggacattgctgacggatacgccgggcttccgggactgggcactgtctcatatgacagaagaagagctcggggctgtttttccggaaattacagaattggcggaagaatgcaggttcgcggattgttcccatacacatgaggatggctgcagggtattggaagcgctgcgggaaaaacgtataaggcgggaacggtttgatgtttatcagaagatgaaggaagagacggatgggataccgcctaaaatgaggcggacacggactgactacaggcataatccatgtatggaaagctttgtctgccaggtgtgcggcaatccggcagcgccggacggagcggggagtatgcacagaaaccattgtcccaaatgtctttgcagtgttcatgtggataatgagccgggagacagggcgtccctgtgtaaggggataatggatccggtgagcgtatgggtacgtaaaaacggggaatgggctattatacacaggtgccggttatgcggcactctgagctccaacagaatagcggctgatgataatccggccatgctcatgtctattgcggtgaagccgctggcgatgccgccttttcctctggacaggctggaagaaggattgaaagggaaataaacggattaatgtcaaggccgtgccgtacacgtgatgtacggcatcggagccgctgaagcggcatcttcagggcattcgcaggggaaacagtataattaacttggtaaactgacagaaaaagtgaatatctgctattgacaaggggaatactggaaactataatcatatttagtggcagaaaaccaccaataatatattcctcgatagctcaatggtagagcactcggctgttaaccgagttgttgtaggttcgagccctactcggggagttttaagtaccgcattacgtaaattcggatatcagcgcataggaatttacgcaaggcggtatttgggattaagcggtttgatagtatactatcaggccgctttatcggttaataatgtaattaatacacatataaaatgaccggtcaaaaggagaatataggatatgagcaaagtaagccagttggaacccaagtcggtttttcacttttttgaagaaatctgtgagataccccatggctccggaaatgtggagaaaatcagcaattaccttgtggatttcgctaaagaaaggaatcttgcttattttcaggatgagctgaaaaatgtggttattatcaaggaagctactgccggatatgagaaagaggaacctgtgattcttcaggggcatatggatatggttgcggtaaagaagctggactgcgccaaagatatgacgaaagaaggccttgatttggatgtggacggagattatcttcttgccaggggaacgagcctgggcggggatgacgggatcgccgtagcatatgggctggctcttctggattcggaaagcattgcccatccccgtcttgaggtggtaataaccgtggatgaggaaaccggaatggaaggagctaatggaattgatctttccatgtgcaggggacgccggatgctgaatctggataatgaagaagaaggcgtgcttctgacaagctgtgcgggaggagccagggttcacggcaggctgccggtggaaacagagaaaaagcagggctgccggcttctgatagaaataggcggactgacaggcggccactccggggcggaaattgataagggaagagctaacgcaaattgtctcctgggaaggctcatgcatttctgcagaaaaaaaggtgatgtcaggttcatgtctgtggaaggaggcagtgcggataacgcaatcccttcggcttccagggcggagctttttgcggaacaggataattgtgcggatttggaagattctttagggcagctggaaaaaatactgcagagagaatatacggttacggattcgggaatcaggatccgggtattggaaaaaggacagggtgaatgggaggtatttacggaggaaagcactaaaaaggcagagatgcttctctttatgatgccgaacggaattcagagcatgagcgcggatatcagcggattggtgcagacctctctgaacctcggtatcctgcggacagagggcagggaagtggagctggattactccgtgcgcagttccgttatgagtgaaaaagaaatgattattgataaggtttgcctgcttttggaatcccagggaggaaaatgggatatttcaggtgactatcccgcttgggagttcaaacagaattcgcctcttcgtgaaaagatggtgaaggtatatgaagagatgtacggaaaatccccccgaattgaagcgattcatgccggtctggaatgcggaatacttgcaggaaagctgccgggacttgattgtgtatccatcggtcctgatatgaaggatatccatacaccggaggaaaggctgagcatttcttccactaagagggtatgggattatgttcttgaaatactgaagaaaaaagagaattaaggagcgggaattatcatgattttatttcaatgtgactataacgaaggtgcgcatcccaggattatggaaagaatgatggaaacgaatttggagcagtcccccggttacggggaagacgtgcactgccgccgggcagcgcagctcatctgtaaggcctgcggaaatgacaggcttgccgtacattttctggtaggaggaacccaggccaatatgacagtgattgatgcggcgcttcgttcccaccagggagtgatttcggcagggagcggccatatcaacgttcatgagacaggtgctgtggaatcccttggacataaagtcctggcggtaccccataaggacggcaagctgactgcggctcaggtggaagagctgtaccagtctcatatccatgacagttcctttgaacatatggttcagcctaaaatggtttatatatcaaaccccacggaatacgggaccctttacagcagaaaagagctggaagagctgagccgggtatgcagggaacatgatttgtatctgtttatggatggagccaggcttggttatgggctggctgcgcctgataatgaactggatctcccttttctggcagagcattgtgatgtcttttatatcggaggaactaaggtaggcgccctgtttggggaagctgtggtaatcgtgaatgaggaacttaaaaaagatttccgttattttatcaaacagaaaggcggtatgctggcaaagggaaggttgctcggcattcagtttgagacactgtttgaagatgatttatatatggaaatttcccggcatgcaatccgcatggcggaaaaactgagagaggctttccgggaaaaaggttatccctttcttgtggagaacaggacaaatcagatttttcctgtaatgcccgattccgtgctggaaaaactttccggcagttatgggtacagttatcaggagcgtgtggatgatacccacagcgccgtgcgcttttgtaccagctgggctaccaaagaagaaaatgtaaatagtctcattgaagatttgaacaattgctgacagaccgtcctgcggatagaaattgcgggaagggagaggaaacgctcccttctcttttttactatataatataaaatcataatcaacaggagcatttttgaagtaaatacaaacatatagtttctaaaaagccattcctaatcacagtatcataataacgtacaacttggaaaaaactggaaatgggagggattggcggaatggcagcaactcaggtattagtggaaatgggagaacgtcttcgcaggcagcggaagaaaatgaagatgacacaggaagagacagcagaactgctggagatatcaacaaccttttatggggaaatcgaaagaggcaacaaaaggctttccatagaaaaaatattgcttgtatacaaaaaaatggatttagatcctacatatcttttgacaggagagattacttcgaataaaatgctggtagaaatatttaaagactgccctaaagaaaaagaacacatcttggagcagattcttatatatttgaaaatgctgtgtaaataagtttgactgaagaagggttaccgggacagatacgaaagaggatatggtggacaatggataatagcaaggaattttttgacgaactatataattctgagtttactcagatagaaaaatatgtccgccgtatgctttatgacagtaatgccgtggaagatattgtgcaggaaactttttttgaagtttacaggaaaagagaagaactgatgaagcatcccaacatcaagggctggttacgtgtgacggccaaaaacaaggtgatgaaatgggaagaaaagcaaagaaaatacagcctggattttgatttcctcatagataattctgtatcggatttaaaccctaaagtcgatgattttaaaatggtggaggtctatactgcggttaaagaaattttgtcagaggaagaattggagcttttacgctgttattatgaatatggttatacttcgcaggaaatagcacagaagctgggcgtcacagagacctgctttaaagtacgtattctcaggatgaagcagaaaatacgcaacagcatgctgctgccatttctttttggtgtttgcggagtattatatcagctgattatattcataggagacaagatatgacacagtcgaaagagcttcaaaatgaaaaattgattaatgatctgtatgaaaagctgcattggtatacgtttgaagccagcgatgaacagtttgacgccgaagaagtggatgccatcgtgcagcttttggatgtattggagccgatgaaagaggacccgcggtatccgtctgatcctgctgcggccagagagcggtttgacaggcggtttggggtggaagaagatggggccgagcgtgtaattgagggagtggctgatgtagaaggggatgaaagcgttaaaatatcgaatagtatgtctgtggcagggataggtagtggtaaggcagggataaaaaaagtctggaagagaaaaaatgtgtttgttcgagtgggagtaggagttgcggcctgtctggtgctgatgttgtcggtgaatgtggggagctatgctttgaagaaaaagtcgttctttgaggtagtgtacgatgagattggacgaacgaaattaactgtaacaggaaatgaagagacgttagaagatgatgaagttataatggagttttctacatggacagaagtagaaaattatctgagcatggatttattagagccggaatatttacctccaaattatataataaagaaaataacattaagggattgcggatctagaactatccttttagttagatatgaaaatagcttatctgataatgttttgcaaatagaagttgatttttatgaaggagactattctgaacgtacattggtaaatgatgcaaattggacgttattacaagatattcatgatgaattaaattcccaatactttgaaaacaataaatataagagtgttaaagttatttttacaaaagataaaaatgtgtatatattactgtgccaggaatcggtagaagaattaaaaaagataactgagagtatgaaatagatatattgggggctgtaacctttttaatgattcagagaatacacagatgtgtagatttgagggaatattacaaaagaaaagaggttacggatatgggaaaaagaattttagttttattattagctatcggcatagttatgaatgtaccattgaaaataaatgcagcagaaattgtggaatataattcagatattcaaattcttagtaaatctgttgttagtggtaatcgtacaagaagtggggaaccctttttatatgattgtgaattagcaattggaatagccaaaaatggtgtggctgttgaatttgctacgagatgttctgaaattgccaccgaaataggagttaaggatgtagttcttcaggaaaaaacactttttgggtggagagatatcataattaaggatcatagtattgaggatgatagtttatatgcaggagctgtagtatatgttaaagctgaggctggaaagacatacagagtgtcctgtacacattatgctattgtagatgatgtagaacttacgttagataattatacagatgaaatagtttataattaatttatttttcctcaaatttacattgtatttattgtcagattaattttgatgattattcgtaggtaatgaactgtcataatgcagatatgctgttatggcagttcattgtaatttatggattatatgaatacggaagcctcattgtagaaactacatatcagtggtataataaattccggatatcattacaaatggctcataggaggaactatggatcagcatatagaacagctcatgcggatggcaagtttggaaatagaggcatatgatatgcagacgaggagagaaatgtcttctctgaatcgaagaatgccctgttatgttatgtcgtatttacagttaggaacagctatattagaaatttacgacgaggtttatgaagtcggaccgggcagtattgttattattcctgagaacgtgttacatagccattataaaacggattgtaagcccgccacatttttgtggtggcatttttcttttaaaattcaatatacaatagatgccctgaaattgtttaactttccggtggtatcttatctgaaaaatcgtgaggaatttgaaaagatatttcacaggttttacgatggaagcagggaaatgaataaattatcggaattgttaatgcatagggcctgtggtttggaactgatggcatatctgtttgaagaactgataacggataaaagattattggttaatgccaggatacccgaggcattctggcagattttccgtatgctgaacggtgaagatattcagcgaattacattgtcgggactggcgcagcagtttcatatgagtccgacttatatttctaatcgatttaaacattatttcggaatttctcctatcgcaatgaaaaacagaatcttatttgaaaggtctaagttaatgctgacggacagagatatgacgataagtgaaatcgcagaggagacaggattcgaaagtattaccggttttactcactttttttcacagagggctggtcagagccccagtgattaccgttcccaaaatcgtcactattaaaagctgctgattatataaaaattggacaagtttaagagcagaataaggcaagtgaaatgtatggatgcattaacttgccctttttttatacgtatgaatatatttatattcagtgataagaaaaaatgcactattttttgaaatatataaaaataaattatgcgaaatgacgaaagaaaatattgttataaattattttctgcctgatttaataattactattatggatcagaatatgtattttgaacaaataacgaataagaataatcattccaaaggaaatcagtcaaacctataattagactatcacttaaaaacaaggaaggttatgaaaggagtcaactatgagaagaaaaagattgctatctgtcacagcattgatgcttactgcatctatggtttttaccggatgtatgagcagtactgtcaagaagaacgcagaacaaaacgaaccgtcatctgcaccggaggcagtggcagagaacaacacatcggaagctgtatcagatgaggaaggtgaggcagaggaagcctatactgatattgtattatgggacgattccacggatggagacgctaatactttatttcaggaactggcggatggctttgcagagaaatatggcgtgaatgtggagcgtgttgttataaagggtgaggacctgcgtacaacggtaaaagctgctattaattcaggggaaggacctgatatcttcacatatgatagtggtgcagggtatcttggggtactcgcaaagtcaggacttgcctatgatttgacagcagtggcagaacaggatggctggaatgatttgtttaaagaaagtgcattggatgcttgtacctttgatgggaaattatatggtgttggaaaccagctcgaatctgtcggggtatattataataaggatatatttgataaatatggatactcagagccttctacttatgaagaatttgaagcaatgtgcgcggaattaaaggaaaacggagaacttcccttgatgttggatgatttggatcaatggccaggctatcattatgaaagtatatggctgaatgcgtttgccggatgtgatgcagtatctgatgtcctcgcattaaagagccaatttaatcaggatgattttgcgctcgggcttgataagatgcaggagattgtaaaaaatggctggaccattgaatcgccgaatgccatggggcatgatgatgccagaaaaatgtttctttccggcaaggtagccatgtatccgaccggtacttgggaagtaggcgcttttggcggtgaagaaggattgggggataagtgcggctttttcttccttcccgctccggaaggaaaggaaacaacaggtgtgtttggtctgggacaggcaattgtggttaacggcaaatccgcgaatacatatacggctgtcaaattcctggaatatatgttcagtgatgaaatagtaaataaatggctggatgcaggttttataccggctacaaataatacagatatcacagcatgtgatgttacccctttatttgccgatgcagcgaataccattgtgactgcggataagatgggaagtaatctggatgttttgctgccttccaaagtaaatgaagtgacggctaataatatacaggaacttctggccgggaaaaagaccggaatggaatgtatggaagaaaaacagaagattcttgatgaggaagtggaaaaaggtaattttgaggcgattgcgaattaaaaaggattgaataaaaaggcgcagactgcctgcggtatgttaagacttaaatgctgcgccttttgttttggcagggaggaaaggagagatacagcgtgaatatctccattaaacaaaggcgcaaaattgggaaatggtgcagagctatgctttttgttgcacctgcattattatgttatattattttttctataattcctatttttaataccattgagttgagcttctatgagtgggatggggcttccgcttttatgaattttgtggggttagataattataaggctatttttcaaaatgagattttttggaaagccctcagccacaacatattctggattctgttcactgtttttatacctacaatttttggtattattctggcggtattactgaatcagagttttgtaaaaggcagacttttattccgggttattttttatatgcctgctattgtttccatggttgccgttggaatcgtctggaactggattttgaatccggagtttggcatacttaacagggcgctcaaatttatcggcctggattttctggcatttaattggctgggagatgaacatacagttatgtgggcgcttctgattgccggaagctgggtccattatggtttctgtatggtaattaccatggcagcactttccggcctggatgcatgttatgtagaagcggcaaagctggaaggcgcaaatcctgtacagacatttttttatgtgacacttcccctgcttaaaaatacatttacactgcttgtattgaattcattaatcggttcttttaaggtttttgaaattgtctatattatgacgaaaggcgggccgtatcattcctctgaagttatttcgacattaatgtaccgtactgcatttatggacagtgaattcggaatgggatccgcagtagcggtggtactgtcggttattatagcagtgtgttccgctgtttatatgaaatactcagaaaaagaatagggggtgtaatgattatgaaggagcgaaaaaaatatccggttagaaaactggtaaaacagatatttacatatgctgtcctgatagctacattttttatttccatactccccttatactggatgtggcaggccgcactggtgccgacagatcgattgaacatggatccgttcgccctgcctgtgaaaatcacgtttgacaatattataaaagcatggaccgtaggtaaaatgagtacatatatgataaacagtgttttagttgcggttccccgagtggcaggggtattaattctgtcctcattggcaggttatgcatttggaaagcttaagttttggggacgtgataaaatattttcctttatgctttttggaatgatgatacctgttcaggcaatggtaataccattatattataatctgcagaatctgggtctgattaacaccaggtgggcgatggttattccgtattttggtttatcgatgccatttgccatatttatgatgagggcttttttcaaagatttaccggaggagttaatcgagtcggcttccattgatggatgcaatgagttcactacattttattatattatgatgccgctcattaaacctgcattatcagcactgctggtatttgaatttatgtggtcctggaatgacatgtttattcccatgctggtagtgtataatgattcggcgaggactctgcctttggggcttatgttctttttcggaaaatatacggtggatcattctttggttgcggcaggtgtaaccatatgtacattgccggttgttattgtatatacattgtttcagaagagctttataacgggaataactgcgggagcagtgaaaggataagcgcagcataattgaagaagacgggagaacgaaaaaatggataaagtaaaggttggaattttaggcgcaggcggtatgggaaatgtgcatattgaaaatcttcttaaaatagaagatgccgaggttaaggctgtatgtgatatcgacggacagaaggcagaaaaactggcagctatggctggtgctgcggtatatgctgattttgatgagatgcttgaaaaagaggaactggatgtactttatatccttttgccgccttatgcacaagcaggacagtttgagaaagccgcggataaaaaaatacatatatttatcgaaaagcctatcgccattacaagcgacagaggaaaaagcatggtggatgcggcaagaaagaacgggataaaaacacaggtaggatttcatatgagatatggaactgctgtcagtaaattaaagagattaattgaagatggatcagccggaaaacctgtattatttaatggaagatatcagtgcaattccctgcatgcgccatggtggagagatgtaaatttatgcggcggacagatctttgaacaggcgattcatgtatatgacatctgccgttatatgtatggacatccgaaagcggtggcaagttttatgggaaatgtatgccatgcggatgtgccgggctatacagtggaagatgtaagcgtatcaatcagcagctttaccactggtgcacaggcatctatctcggcaaataattgttcggttcccggcagatgggatgctttatttgatatgatatttgaaaaggtcagtgtttttttcaaaagcccggatgaagcggaattccattatataacggacgaaggggaacgggtggaatattttaatgaaccggctgatcataaatttttggaagacgaggattttatcaggatggtcaaagagaacagaacggaattctgtccggtagaggaagggctgagaagtctgctgtatgtggaagcttccctgttctcagctaaaatggatggagagaaaatgcgtgtggaaaattattaagaatgtggggactggatgaaatgagagaattactggcgaatgaaaattatattcctcagctttttgaatatgaggaaaaacctcttgaaaaaggtgaagtacgtgtaaaatgcatatatggggctccaaagcatggaacagaaatgacagggattaaggaacagcctttcgaagaaaaatactatgatgaagagatgaagatattcctgcaaagggaagagaaggtcagttctgtatacagcggtttaggcaatatgtgggtaggaacaataacggaagtgggaagtgatgtggaagcgtatcatgcaggagatcaggtggtcggctatgggaatctggcacagacacatacggttaatgcgcaggaactccttgtaatgccggaagggatgacctggaaacaggcaatgtgttatgatcccatgcagttcgcattaagtgcaatcagggatgcgaagttaaggctgggagataccgtattgatttccggcttgggcgctatcggacaaatggcggcacaagcggcaaaagcagcgggggcttctctggttgcggtgtcggatccgattgaaataaggcgaaaagcagctctggaaaacggagcggatatcgcattcaatccgttagagtgtgatatgggattagaactgcgtaaactgacaaatggtgtgggagttgatgtggtgattgaaacgagtgccaattataaagctctcgaacagggaatcagggcgctggcctataatggaagcatggcattggcaggctggttcaaagaatgccatattcccatacatctgggcagggaagggcatttcaaccagcagaatattttcttttcaagggcctgcagcgagccgaacagggattacccaaggtgggattttgaccggatatgcaaagaaagctggaaactgctgggaacagggaaaatacagtgtgagaacattgtatatccaattgtagattttgatgagtgtgacaaagcgtacattcattacatcatcgaacatccggatgaaagtattaaaatgggcgtaaaattctgacagcaatacaaataggccgcttctgccttcaaggcaggagcggccctttcgtacaaaaaacaatggccgtattatcctttcactaaacgaaataatggcaaaatgaaataaaaagtagaataaaacctgtttcttcttttccttttcgtagtataataaagccatccaaaagaaaggaatgaccacaaaagaaaatgttaaaatcatacatagccttcgacctggaaacaacagggctggatccggagcaaaatgagattatagaaatcggcgctcttaaagtaagggatggaaaagtggaagagagatttatggagtttatccgtccctgccagcctgtttccaagacgataacggatcttacggggattaccaatgagatggtggcggatgcggaggacagtaagactgtcattcccgcttttttggaattctgcgggaatgatgtgttagtgggccataatatcatatttgactatagcttcatgaaaaatcaggcggccattctgggctatggctttgaaaagcagggagtggatacgctgaggattgcgcggagggtacataaggatatgcgttccaaaagcctggaggccttgtgttcctattattccatagtgaatcccgccgctcacagggcttatcatgatgctcttgcgacagcaaagctgtaccagacgctggctcattattatgaagaaaaggaacctcaggtctttcagccggtggttcttaattataaggaaaagggaagggaagaaatgcctgcgacgaaaaaacaggtagattttcttatgcgcctggccgtacagaaaaaggcggctgtaacctgggatccggataagctgaccaagagtgaggcttccggattaattgaaagccttctggccggacagggaggaaagtaatcgttaattgcttttgaagaaggttctgtaaagcagctgtgcctgccgtattttctgtggaaaagaaaatacggcaggcgggaaaaaaggctttactggccttttgtattccagatatttgccaaaatatcttttagtacaaggaaggcgtcgatatcattatatccatactcttttttcaaacgatctgtcatttcttttaattggtccgcgtaatccttgatattaacctcattctgataggtggttaaaatcggatattttttaccccagacctttgtccagtctactttcttttgtgtttcttcgcttgtgttttcaatgacctgttctatttcttttaaatttacgtcaaagtcaatcagttcatctaaagacagatgatacaggagcgccagcttctttgcctggcgtatgtcaggaagggtttcatctgtttcccatttcgaaatagtctgcctgcttactcccagtttttcagccacctcttcctgggataagccgctttttttccttgcgttaaataaattgtttcctaagttcatatatcttacctcctcgtttcgtatgagataagtataagggggaaggaaaagaaaatccatcaattatgttttgcatttatgcaattattattaacattcctgaagttctgttttttccttttaacaatggaaaaaaaggagggcaggcaggcgaggagaataagaatcaggcatacggttcccagggtgagggtatattctgtgaaattcctttcgttgcccgtgtaggctccattcaggaaggggagtcccagcgcaatggcaaagtaccagaacacgggcggcaggcatttgcgcagtgtagcaaaaatgggggaggagaaacggccgggctgccgcacaggggcttctgttcggcctgtttctgtctgtatttcctcggggtttcccgctatcaggagggcaaggtttccggccggtttgtataggataaagagggcggtgaaatatacgatggcccctgttatcgtatggagcctttccgctgtcatccatccgttgtcccacatattctgaggaagggccaggggcagataaatggagaggacgatccgaaggccgtttaccaggatcgtgtaaatgtaggaaataaggaagctgagtatggtccagcatattccttttttgtgtgttggcattctgtgtacgaaggaataaagcagcgttgctgcggcaatgagcatgaactggacgccggagcaggaaggggctatgatgaaacggaaggaatggctgacatagccggagccgggttcatagtcaaaaggaatcccgctgaggattctgacccacagggaggtcggggccagaatccatttaaggtcggggacggaagctttgctgtaaaaaagcttgatgcccagaataaagagcatgcctgtcaggtagaaaattccgttttgccgcagaattgcttttgcattatttttcatcttgcgctctttctttactgaaggcaggtttctttttactgttttgatacaggacattcaggagcactgcggcggccatgagaaggacaagaaggagacttcccggttccgagccgacagtgtagccgtttcctatggcccattcggatacattcatggggataggaaggggctgttttacatcggtactttttccttcggtgttgcgtactttttcggtaacggcaatgaaggaggtatagggggtcatcatgctgtagcggagtcccagttccgtcacttcttttttggcattggcctggaggtcttctgtgattccgtaatctgtcagccgttccactctggtacgtgcccacaggtattgtatgatgttattggcttccaggggaatcacggcagataccggaatgtcttccgcatagtcccggccgccggtcttgccggttatgtgtatggttccggagggctctcctttccatttgccaaaaaggacaatgggtctgctggcaaagagggtggaaagggtgggaggctcgatgtcatagacgtcaaagccgtcataggttacctggacatcggtcaatacgggggactgtatataagtacggaaacgatcggcagtggcggcggcttccgaaggatcggttaccacaaaggattcgcccaggccggttttggcgataccgtcaatcagatagcggttgacggagcttccgattccgaaggagaagaaattggtggtgccgatgttcctgccgatgatatcgaatatctctctttcaccggagatatagccgtcggtaatggcgatgacgctgcgcgctgcgccgggggaggcaggaatggcgagtgccgtttccagggcgggggccagttcggtaccgccgccgccttcttcattatcaatgagggcaaacgccttttgtacattttccgctgtggcaggtacggattccggtgacatctggataagggaatcggaaaacaaaatgacattaaaacggtcggtttcccggaggctgcctgccaaattccggatgagttcttttgaggtatcaagaggaaagccgtacatggagccggacacatccagaataaaaatatattctctgggaggaatcgtttcaggagtataacgttccggaggctggaccatgagcaggaaaaagttttccgattctccggtacccagcatcaggccgctgcttatttccgtgcctgtaagcttataatccaggataaaatcccggttcccggcaaattcttccggattggagagggagatccgggcggaggtctgattgtcccatgccacatcaattttgtgggagccgcactgcagatccgtaatgggtacgcctgcggaaagattgacattaatgttgtatttttccctgggggtatctcccaatctcagaaaagggctggcaatccatgtttccgccttcagacttttggggacggaagggcttgtataacgggggccggccacggtgggaaagacgaactgatagatgccgtcggtgggagtaatcatttccgtataatgcagttcaatacggatgatatcaccgggcataacgtttgccacgtccatggtaaagacattgggccgctgctgttcaagcagggaagcgctttttccttcgcttttagcctgctcataatcatgtctggcttcttccttttcctttattttggcggtgatgatctcatcccctatttccattttcatgccatggatggttactctggaggaagccggaaagacataggtggcgtttatcggatcctgcccctcgttggaataggtctgggtgacaaaggtttcggcaaaaatgccgttgatattcacggatacattggtttccttcagcgggaagctgtctgtcgccgtatccattccgtcgatcagaaagtatggagcgagagtggcgtcggtatcgtcatcgtattgtgctccgcagatagtagtagagtgtgcaaagaacagtaaaagtgtaaaaaggatgcatagccggtgtttcatttttctcatgatatttacccctcattcgtctggcggactgctgaaattaagtgtccgccgtttcttttttttctccgctgaggctccggtcagttaaaaatgactttgcctgcggcgttctttaagggtagcgtatcatgtgccggcatcataaaagcatcatatgtgcatcatttttgtatcatggaaaaccgaacgcctcctttcaggcttcccaatagagaaaacagggcaaaggccgcgatgtcaacggctacgatggtggatcccaccggcgtaccggccaggatggatataaggattcccgtcaatgcgcagataacggaaagtatggcggaacatatggtaacggatcgaaagcttttaaacaggcgcatggctgacagcgctggaaaaatcaccagggcggaaataagcagggagcccaccagattcatggccagtacaatgataacagcgatgatgactgcgatcagaagattgtacataccggcttttacaccggtggcctgtgcgaagccttcatcgaaggtgacggcaaaaattttattataaaaaaggataaaggtgattaccacgatcacggataaaacggcgcagagccagacctccgtttttgtcagagtcaggatggaggtggagccgaacagggtactgcacacgtcgccggataaattggacgaggttgaaaacaggttcatcagcagatagccgatagccagcgccccgacggaaatcatggcaatcgcggcgtctccctttattttggtattctgacctgtacgcagcagcagtatggcacagagtaccgtagcaggcaggacaaaaagcatgctgtcgctcaggttcaggacggcagctaccgccatggccccgaatgccacatgggacaggccgtccccgataaaggagaagcgtttcaggacaagggtgacaccgagcaaagaggagcagagggctatcagaacacctacgataagggcatagcggacaaagggatactgcagatacagtttcagagtttctatcattgtgctcattgcatttctcctccttccggcatggtaaaacgcctgccgatatcactgtccatatattcctgctttgtcccgagaaagattttttcccccatatgcaggatatgggtggcataggtcagagctgcgcctatatcatgggaaatcatcaatatggtaatgccgtcctgccggttcagtctgcctatcagagcatacatttcggaagccaccttcggatccaggccggataccggttcatccagaagcagcagcttccgggtggcgcagagggcgcgggctaaaaggactctttgctgctgtccgccggacaattcacggtaacagcggccggagaagtctttgatccccaatttttccatgttttcttctgcaagttctttttccgccttcgtataaaacggcctgcttccgcagcgcccctggcacccggagagaacaatttctctcacggatgcgggaaaatccctttgtacaagggtctgctggggaagatagccaatctcattcgtcttaaggccgtcgcccgtaaggatgcttccgctgacgggcggctgcagatgaagcagggttctcatcagcgtggatttaccggaaccgttttcgcctacaatgcagaaataatcgcctgcatttacacggaagttcagattgcgtacgatagccttgcctgcgtaacccaaggcaagatcctgacaaattagctgagacatagcaaattcctttcttattgcaaagcttcttttaatacatccagattgctttccatgatggaaagatagccggagcctgcagcgacgtcgttggacgtgacggactgcatggaattaagagttaagatgttctgatttttttctttggtattctgtataatcgtctgtgcgattttctgatccgatgattctatagtaagaacggaggtaaggccgaactcatccgctttatcggccaggaaggtgattgtccggaagctggcttctgtttccgcagagcatccggcgaatgcggcataatagctgaggccgtaatcgtccacaaggtatcggaaagggaatctgtcgccaaagagcagcgttttccgggaggcggaatcaaccgcagactgataagcggcgtccagggcatccagcttttcgccgtaagaggtcagattagaccggtaatcggctgcgtggtctggatcaatttctgtcagggcgttggtgatagcttcgcagagaacctttgcgtttctgagagacagccaaacgtgttcatcgtattcggggccttcttcctcttcgtgctcctcgtcttccccgtcaccgtgttcctccccggcttccatgccttctacgatttcctcctctttgatggcatcgtccagcacatccagaagatcaattaccttcatgtctttattggctgcttcctggagagcgtcagacacccagccgtcggactcaccgcctacataaataaacagatcgcaggtggaaattttcaaaatgtcctgtgcggtgggctggtagctgtgcagatcgacaccgttgtccagaagcatggtgaggtcggcgtttcccgcattgtctccgagaatctcccgcacccagtcatattccgggaaaatagtggttacgatgttgagatgtttttcgggaacggactgtgcatcggttgttaccatggcagaagaagcttcggaaaagtcttccccggaagatggggcagaagggcttgcggcagtattatccgcagagctgccgcaggcaataaggcccgtaaaagccagaagggcagccagaataaacatatattttttcatagaataaaaacctccataattttgctgattaaaaaagggtgcaaaaataacagggtatctgactatacctgcctgaaaaaagagtataggatacccctgaccggaaatcggtttttattcaattattcagtcgtaccttatggcttaccagtgaagctgcggggatgaagtgaagagcccgcggaagaaaagaaagaaacagtaaaataagaaatgccccggataccgcgccggaaaatccggtgccaagctgccggaggctctgctccgcattatgaacgcaggcacagacagggcagtcctcgcccgtacagttatgattgagttcatgaccaataaaggagatggaaaaaagtgtgatgaaaaatatgaccccacagataagcagagcaaggcttctttgcttcttggtatacactgttttcctccttccattgtgaatgtctgaaagctgattttttattatagcacttcagccggtaaagtcaatacggaacatggttgtaatacggtcggaaacaagcttaaaatggcagcgggcatacaggaaggcaagcctctgaggatggctgggtatttataaaatgagttataaaatgcgtgtattcctcactaatatgcgggaaaaacctatttattgccgccgtaaacggttgtaaaatataactgtttgatgtgtgtccggaatgtcagatgcgcagagcggcataagggacaagcggaaatgataatttttaatgtataacatgtggcgcggacagcgcggaaaaggagtgacaggatgaaggtaaaaagggcagccagcataccgctgattttgcatgatccgtatttcagcatctggtccggaacggataagctttatgattccgataccgtacattggtgcggaaagagacagaaaatcagaggatacataacgattgatggggaaagcttctgctttatgggggataaggaatttcatcaggtgattccccagaccggtatagagcttacggcgacagggacaaaatatacctttgaaaatgaaaaagtaatactgacggcggcatttacctccccgcttctgcttgaggagccggtgctggtatccaggccgtgtacttatgtggatttcgaggtggtcaggaaggcaggagaggccgatgtgaccattgatgtgcagatctcggcggatctggtgcgttttacgccaggagcagtagtgggaggttcttatcagacggatgccttttcctatgcggtaatggggaaggctgagcagaaaccgctgggacacagcggggacaatatcacaatcgactggggatatgtatatctggcggtgcaggatgccttttcacaggtgtgcttcgataaggcaaacgaacagattacggcttcggtgaagctgggaacacaaatgggctgcggaacgcttgtggcagcctatgatgatctgctgtccatcaactatttcggagactggaaaaaggcctattggacagaaaactatgccacgattctggatgcggtaggagccagctttgcggataaggactgtgtacaggaaaaatgcaggaagctggatgcaaagattgaggaacaggcggcggctatcggcggtgaggattatgcattgctttgctgcctgagctacaggcattccattgcagcccataagctgattgcggataacgacggcaatcttgttttcctttccaaagagaacgattccaacggctgtctggggacggtggatgtgacctatccttcggttccgctttatatgctttataatacggaatatgtaaagggtatgctgcgtccggtatttacctttgccgcctgtgatgtatgggaatttgacttcgcgcctcatgatgtgggacgtttcccttacgctacaggccaggtgtacggccttgcgggagaaaagagcggttccgcctttgacggcagcaacggcactgtgttcccgtttttctatcagtatcctgccggaagccggatttatgattttaaataccagatgccggtggaggaatgcggcaatatgctgatactgactgcggcggtctgcaagctggacggttcgccggatttcgcggcgcctcatatggaggtactgaagaaatggtgtgaatatctgctcacctatggtgcggatccgggcgaacagctgtgtaccgatgactttgcaggccatctgtcccataatgtaaatctttctgccaaggcgatcatgggaatcgaagcctttgccctgctggcccgccagatgggacaggaagaggtttatggggaatatcatgaaaaagctgtgaaaatggccggggattgggaaaagagggcggatgcaggggatcatacggctctgtccttcggtgacagggattcctggagcctgaaatataacctggtatgggataaattctttggaagcggcctgttccgggaggaggtgtaccggaaggaaatcgattactatattaaaaagagtaatgtctacggtgtgccgctggattccaggaaggaatatacaaagagcgactggattctctggtgtgcttcgatgactgacgatagggagaaggtggatgcgcttatcgctcctattgcagcttatgtgaacgaaaccccttccagggtgcctttttctgactggtatgagactgttaccggcgaatactgccattttattgcgcgaagcgtgcagggcgggatttttatgcctatgttgatacataagaatggaatttgacaggttccttcagattgattggggtggaagaagggatattttttgaacttgagccggggcggcagccccggctcaagctatagatacaatatcttcgtattgttgttatgcattaattcatgttataattttagttaaatcagaagtccggaaggagcagcaattatgaaaatgccaaaagaaaatatggatatcaatatgtttgctccctgcggaatgaattgtatggtctgttataagcattgttatcataaaaagccatgtgcaggctgtctgaacagtgatacggggaaaccggaacattgccgtaaatgtaagataaaggactgtattgggcttaaagaggggaattactgctttgaatgttccgattatccctgcaagcagataaaaaatcttgagaaaagctataacaaaagatatcaggcaagccttatggaaaacagtgaatttgtccgggagcacggcctggagctttttatggaaaaacaaaaagaaaaatatacatgtgctaagtgcggcggtgtaatttccattcatgacagggaatgcagcgagtgtcaggaaaagatgaaatgattatattctaaatagagggaaataaaaagtatagtttatatacagtcggagccagggcggatgccccggcttttgcagtgccatatcatcttatggaacatgggatgtggtccggttcccggataagcccatatatgcgatcaggagtgaaataatgggaaatatagttaccaggcgtttaagaattagagaatggaagccttcagatgctccggcgttatatgacatttttcaggatcaggaaataagacaaagtgggatttgtttttgttcttcaatagaagagtgccaaagaataataaaaaaatggacagaaaagaatgaaatgaaggccatatgcagaaaagaggataattgtctcatcggcttaatcggtttaaatgatatgggacgatatgaacagtataaagaactggaatatgccattgcggcagattacaggagaaacggttttggagcggaggcggtcagaggcatgctggattttggctttcgaaagcttgatttatcagtaattgctgcatgggtccatgctgctaatataaaaagcgcacgtgtgctggaaaagtgtggatttacactggagggacggctgagaagacatggccgtgacagaggagacacattgtgttattccatattatctgaagaatttcttaattgaaaacaaggcggttttgaataggaaaccgccttgtcatattacatctgctggatgtataaattcaataatcgaatttcttgtatactatcctgtttatatgattggagtctttaatcctatatacccattgaatgctgttaaaaaagcaatcattgccgcgttcaccaaaaaagcgcctgccagtttgcctccctgtaaggcggcggtttccttcaggaaaatgatatacaggataatcttccaaatcaggatccccacaaaaacaatgctgagaaccatgctccatagcacgctgttccagaatacatagaaataagcttctgtgactgccactataaaggaacaaatgatgttgggaaaaaaggaaattccccatgtgttaatgtaaaccgataatgcggtcttgctgccgaagcatttacagataagccacagtatgcagcttatcagcagatagcttgcgatcccccatagggcagtacggaatatgtgaaataaatcggcatggtatcccggattggaaaaataatgcagaatcgggtcgaggacagtgactataataattgtggctgccacaaacagccaggctacagctctgctttgccgccggtaggcgtcggcgggtctgtttagggcttctaaaaagttcttcataattcagcctccgaatatgcttaaaaacaaatttgtatatttagttccgaataagagggtgcatatcaccgtttgtacggtggaaataccgaaagcaaacctccagggatagattgtaataaagctgcggatttttccccacgtagtaacttcctgtccaccctccgacaaaatatagttcagcatgttatccttctgccgctctgttggccgttcgggttctttcagcgtgtcaaatgcgtttttcaatgagtcattattccctgtcattctgcgctccctccatttcccggtattgtctgataaatgcgcttctggcccgtccgagcatgctttccacggacttgggggatttatcaacaattcgtgcaatttgtttcacactgatttcctcaatatatttgagtgagagtaatatctgatattgtttcggcagctggcttagacattccttcacctgccggttctcaaaggtaacctgcatgcaggtatcgatattctgcttcggatcacttaactgatcggacagctgatcatccagaggaaggatttctgtcttttggctatattgtcttcggtaataatcaaacagcttgttctgggctatcttgaaaatccacgttttttctgaagacagtcctttaaaaccccataaccctttaaaaacatcgagaaaaatatcctgtgtcagatcctcggccagaggaacgtcaaaaccggtacgcagaagaacatactgatatacttcgtccacatgttttctgtatattgagatgaaacgccgttctcttgcttctttagcctcgttcataggcatatacctcattttacggtgagttctgtcgagcttagaagctcattattgtagaatacttcaaattgtaagcttcccttctttacatcgtcagcttccagccggtagataacagcgccggatttatctgtgattgtttcctgtgtgtcggatttaatttcttctccgttcaagtaccattttcctgtatattccataccttttggagattcaataaagtaaatgctggcatagatgtctgttccggcagaaacctgttccggctgtacggcatcttcaatatcctcttttgctgcgtatggttcatttgatacaacaaggctttcgacggtattgagctgtccgcatccggtgagaaaaatgataatcattgcgagtgcaaaacatggccggaatatttttttgagcgctttcattgtgcagttgcctcctttttcgttttttgtgtaaacaaagccatatctcctttccggagctgatttacagttcctaaaagggtagtcgtatagaagcctgaaatcattcgcatgattcaaaaatatttactgaagggataatcacgatgaaatttttctgacaaatatatgtatttgaacatacatgaaggaatgagagtacggggcagcagccatagaaataagctgtttctgaaataatgattgcggcatatttgttgacattaacaaatatgtccactaaaattttaagtaagtaattatggtttatcttatgacagcttgatttaacttcaggattactcttaattttgtaattacatatttattcagctatgaagggaggtaagatatggaaataattgaggtttcagacagaacgccggaattaatggaacagcttcttattatttgggaaaattctgtaaaagaaacgcatttgttcttaagcgaagcagaaattgctgatatcaggaaatatgttccccaggcattagcgggcgtgcctcatttaattgtggcaaaggatgatgcaaatgagccgattgcatttatggggattgataaccagagactggaaatgctgtttgtaagcccgcagctgcggggacggggtgttggaaagaaacttattcattatggaattaaagaatatgcggtcaacgaagtaacggtaaatgaacagaatccgcaggcaacaggcttttatgaacatattggtttcagagtttacagaaagacagatatggacgaacagggaaagccttatccgctcctatatatgaaattgtatatggattcagagactgcagggaagaagagaaaaaaagcagtgacggcagtgtttatcgttgccgccgcagttgtagtgggagtggcggtagccgtagtttttttaatctctctttttacagagaaaaatgtagtcactgatatcagggaatatgagaaatattttgggccgcaggggatacatcagtcgaaaaatacggatgcatgggagaaaaccagggaatcctatctggttctgaattatatatttcctgaaaagctgcctgagtcggcggatgtggaagctttctattatgaatattataatccatgggatccctgttatctgtgttatctggtatatagctgtgatgaggaagactataaagcggaaacggaacgtctgaggcaaatcagtatgcccaaggattatttgatttacggctcaaccgggtttccttatccgctgcttgccgtggatagcagcagctatggttatatatatgccatgacagatgaggctcagaataaaataatctatgtggaattaaccttctgtaattatttcacggatattcattatgagagagtgataccaaaggaacatcttccgatagggtttgatgcgaaatcgggtaatccatacagggaggagtatttgtctcagttaaaataaaagggacggccgcacttcaacaacagtgcggccgtttctgcatagtctaatcttcatcaggaagtacattctttttcaggctgttatatgccaatccgatataaagaaggtaaatagataaaaacagggcgagtataattcccgcaatagccaggagttctgccggtccggtcacaacaccgggatcgaaggcgcttcccagggcgaggataaaaggaatgccgattaacagcggcggtatggcgggcattgtataaaagatgatgaactgccggcgcagcgcctgtttcatttcctgccgttccattcccagcttgtgaagcaattcaaactgccgccggtaacggccggtttcactgagctgctgaatggtaaggatggtggcggataccatggtgagcacaagcgccaggtaaaaaagaggaaagacggtgatagcataagtggatgcgttttcgtgttctatctgggttttacagaaaatagtatcgtagccggagatgacttcatccctgttatcccgtatttcatttatccggttatattgctccatggtcatgggttcttctgtcatggcagcataaatattgtggctgacaggaagagctgcggccgcatcatcgggaataataagaaggaagccgcggccgttgccgtcccacagtgactgggtaaagccttcgctgtatacgcctcccggaagcagtgtctgatcatctatagtaagaggctcattatagctgtccattcttttttccagataaggcatgcagtgaatgagatactgcccgggcttgagggaaacctccgggtaaccgagcatggcgcgaagggccaggtagtcgctggccttcattatggtatcataatcaaagctctgccaataatcgccgtccgatatggcatagcgggtcacttgcgtgtcttttccccggtaaatatcatactgccgggattcccggatggggacattgccgtcaatataggccagatattcatcaaagcgtgtggaatcccgttcgaaggaggagataaacagatcaaagcaggtggtctgttcgttccggtcctgaagcaggacgtggaacagcattccggcgccttccgtgataagggttgccgttaacagcagggctattgtggccatgacaacgcccatagtggcaagcttggctgacagggtacggaaaataagcagcgtgtggcctttatattttttcccggggcgtttgtcgaaataggcgggtacgccggaggagaagctgataaaaaagccgtaaaggaaaacgatgatacatgctgatcccaaaatacccagcggaaggctgcgcaggagcagcaggatagtaccgatcaggcctgagatgatggatataacgaatattttccggcggctgcggctttttttcagaagctctttttcgttctgacgatccgaataaatcaagtcacagattttcatggtacgtatgcgccggcggctgcggaagagggcaaacaggtacaccaacgcaaaatagaagatcgttaaaagcacggcatttaacgaaaaagaaaaacggaaggtataaggcgcccggaacagagtgagcatgaccgcgcgcagggcctgaaaaatcagattgcccagaatcgttcccaacagcagggcaattccgcctactgccagattctccagaaaaaacagccttgcgacctggctgttttccaggccggtcaggatataggtgcccagctcccgtccgcgccgcgtcagcatgaagctgatggtatactgcaccagccagccgatgatgcagactacaactatgctggcgagtacgattatcaggggcattacctccaatgccgccgacagtctccggatttcctgagaaaaaaccagtccgttgaaggcatagatcagggccgccgacatcacaatcgtgacaaaataaaccagataatcccgggcttgccgccgggcattccgaagggagagtttagataacgtcactgatatcacctcccagcaaggcgagaacatccaggatttcatggtaaaacacggtccgtgtgcgttctccgcgtatgagctcgttgaacaggcggccatcctttaagaaaaggattctggacgcatagctggcgctgtaggcatcatgggtgaccatgagaatggtggcgttcatatcccggttcatccgggtcatgatttccagaagatttttggaggatttggaatcaagggcgccggtaggctcatctgccagaatcagcgactgccccgccaccatggcacgtgcgcaggcggcccgctgtttttgcccgccggatacctgataggggaatttggagagggcgtcttcgataccaagcttaatcgccacatcatggacttttttctgaacggtaagagcatccgcatgattgatagtgagggccaggccgatattttcttccagagtcagggtatcgaggaggttaaaatcctgaaaaacaaagcccagccgttcccggcggaaacgcgccagttcaccggagggtatttccgtgatgttttccccgtccagcaggatacttccggcactggccgtgtcaatggtggaaatacagttgagcagtgtggttttgccgcttcccgaagcccccatgatagcgatgaattcgccgtcctccacatcaaagctgatccgatccagcgcttttgtgacattgtttttgcttccataatatttctctatattttttatgtgcagcataatcgtgtctcccttctttcaatggtataagagcaggatacctcataagcaagggcggcggtatcgaagttatattgcactttcttacatttttgaaaggtttgtgcgtcagtcagtctgtggagctatggattctggggaagggaaagtcaggattacgcttgtcccctgtccttcggcagaatgaatctgcagatcgatttccatggaaccggcaaggcggcggcacagatacagtcccataccggtggaaccgccgcgtgaccgtccgttgctgccggtgaagccccgttcaaagacccgggggagttcatgagaagggatgccgatcccgttatccccgacggtaagctgtatctgccggcccagctgtcgggcggacagggtgatgaccggggtatcggtgcggtatcggaccgcattctgcagaagctgtcctaagataaagcatacccacttgccgtccgtatacacggtttgcgccagattcacggtctcgatccgcacaccgctttgtataagaagagactggtgctgttcgatcgcctcttccgcgatcccggcgagatcggtccgggagatgataaagtcattttcagggctttccgcccgggcataaaaaagaacccgctccacatgattatcgatttggctgagttcccgggaaagctttgccctcagccggggatcagcgctgcggcagatcagcctggcggccgtaatgggtgtcttgatttcatgaacccagctttcgatatattcccggtagtcccgctgtgcgcagcgggcatcggatacggcttcgatcatggctttgcccgaccggcgcatcagctgataaatccggcgttcataggcgttatgggggttgggcacacattcggaaaacaggtgcttctgatcgagcccgtccataatggacttcagctcatccagatgggaacgtaacttcagaaaatcatatgcctgcaggataagaaacagcaggaaccagacgataaggatgatgatcaatatgccggcctgtgtgccggttgccagcagaaaaacggccatgacagccatggataccggctgaaggacgagccgtccgagcctgtcggataagaattcttttaatgtcatagctgataccccaatccgcgccgtgttttgatgtaacctggaaaaccgagttcctccagctttgtcctgagacgtgttatgtttacgctcagtgtgttatcatcaatgtaaatatgactgttccataataattcgattaaatcgttccgtgaaatgatttccccgggatgattcatgagatgcgccaggattttaatttcgtttttcgtcagctccgcagtccgttcacctgaggtaaccacaccctttgagagacagaggctgagtccgtttacgttcagcacatcaggttcctgctgtctgctgctcctgcgcagaacagctttgatatgggcaagcagaacagggatgttgtagggcttggtaatatagtcatcaccgcccaggctcagcgcccgcagctcgtccatggcggaattgcggctggtgacgaaaatgattgggacgcctgttttgctgtggatatccgcgcacagggagaagccgtcccgtccgggaagcccgagatcgagaagaatgagatcagggccgctgtccgcggcctgttccggtatattaacgaagtcatttataaccagggcctgatagccttcattattcaaaaggatagccagttcctcccgtacggacggctcatcctcgataatcattattttctgcatagggcaccacctttatttcctttgcctccatagtaacacagaacaatcgttttgggcaatttctattaagacatacggtttccttttatggtaaaatgggaacagttcaggcaggattgaactgcgatacaaaaagaaaccgttcatgggattactgtaccggaaccatgccgtgagaagtacaggggtatgggcgaagtttgagtaaaataaataaggaaagaggctttcatatatgagtaatgaatcagcggtcagaagcgtgctgcaatacatccgggataacctcaatgaagatctgacattggaaaaaatcgcaaaagaactcaattattccaggttctatatagccagggcttttgcggaaaatacgggctgtaccatatataaatacattcaggggcggcggcttacggaggcggcggaaaagctggtatatacagatataccaattgtggaaatcgcctgtgaagccagctatagttcccaacaggcgtttacgctggcctttcacaagctgtatggatgtacgccgcaggaatatagaataaaaggtgatttttatcccaagcagacggagatatccatgtgcagcagattttattctgcgtcctgcaggaacaaggcggggaggatggcggcatgagtacagcgataccctatgtgatagaacagactaaaaatggggagagaagctatgatattatgtcaaggcttttgtccgaccgtattatttttctgggaacacaggtggatgatgtttcggcagagctgatcgtggcgcagctgctgtttctggaatcccaggatcctgaaaaggatatccagctgtatatcaacagtccggggggctccattacggccggattcgccatttatgatacgatgcagtatatcaaatgtgatgtttccactgtgtgtatcgggatggcggcgagttttggcgcggttcttcttgcgggaggaacgaagggaaaacggatggcgcttcccaatgcggaaattatgatccatcaggcggcgatcagcggaaatgggatacagggaccggccagtgatatcaagattctgtcggatcatatgcagagaagcaatcagagggtgatacggatcctggcggaaagtacggggaaaacggaagaggaactgaaggcggatacggacagggattattatatgtccgcggcggaggcgctggagtatgggatgattgatcagatatttgatgggagaaggcgttaagatgctttgtcatcagtaataaagctccatgtgaaggtaagaaattaaagcagtggctgggttatggccccagaatcaatataataggatagtgtttcaaaaaggtacctctatttttatgaagatgggggtaccttttttggcattaatatatagctgagaagggtttatattactatttttatgtagttgaattgcttttggaaaagtataaacaggcctaattggtatattgggtataaaataagaaatatttggtatatctcttgcagaaaagatattaaaatgttattttatataatatcttaaataaacgaatagaaaggatattaaagactgaacgaaatattatataaaaaattttttattcttattctgttttctgtaaaaatttataaaaagatatatggtataaatggtatatcgtaaaatacataagggagaaaggatatgacaaaagaaaaaaaggggaaatacaatatttttactgacgtacggaggaacaaggtatcctatctgatgctcattccggcagcgatgtatactttcattttcggttactgtacgattccctacatgattatcgcttttgaaaaattcagttttaaaaaggggattttcggaagcaagtgggtgggaatgaagaactttgaatttttcttcaaatcacaggatgcgggattgattatcggcaatacggtaaagctgaatctgctttttcttctgtttaccataacggcggcagtgacacttgccattatgataaatgaaatccggaataaatatttcaaaaaaatagctcagtccacatacctacttccctattttctttcctggattattgtaaactatatcctttatggaattattggcagcaaatacgggctgctgaatcatatcgttactttcttcggaggaaaatcaatcaatttttacaacgaacccaaatactggacaattattcttgtcatcctgaaggtgtggaaggatttgggaatgaacatggttatttatctggcgaccatcaccggttttgatgaggaattatatgatgcggcggcggtggacggtgcgagccggtggcagatgtgcaggagaatcacgattcccatgctgatgccaaccgtgatcatgctgggaatcatgtctatcggaaagattttttacggagatttcggaatgatttatgcgctggtcggggacaatggagtcctttatcataagacggatgttattgatacctatgtattccgtacgctgcgtaccacaggaaacccgtctcaggccatggctatcagtctttttcaggcaattatgggatttatctgtgtatggggctccaattatatagcgaagaagaaatttaaggaaggagcgttgttctgatgaaggataaaaaaatatcatggggaaaagcgctgatttatctgtgcactacattgacggcggccttctgtgtgcttcctctgctgttgattttaattgtttcctttaccaaggaatccgctatcgtaagaaacggctattcgtttttccctcaggaggtaacactggacgcttatgccatgctgtttgagaatggggcgacggtactcagatgttatgctaattctatttttgttaccgcagcaggcacggtactggctgtaatgataactgcaatggcttcctattcccttgcaaatccttccgtgaaatacagaaacgggatcgccatgtttttctttgtcaccatggtattcaacggaggaatggtgccctggtacatgatttgtaagaagatcgggctttctgaaaattatctggcccttttgattcccaacctgattttcagtcccttcaatctctttctggtacgaaattatatgagtgagatacctgcctctctgatggaatccgcaaagctggacggggccaatgacggacaggtggcctttaaaatttatttcccgctgtgcaaacccattctggcaacggtagggctgttctacggaatcgcatactggaatgactggtggaactccatcatgctggtttccgatgcgaagtattatccgattcagtactatctgatgaagctgaaatcggatctgaattttatgagaaacctgcagagcgccggtattgccgggggaggttttacgccgacggaatccctgcagatggctacggcggtgatcaccataggcccgattatcatgctatatccatttttacaaaaatatatagtgaaaggtcttgtaataggaggtgtaaagggttagggaaaagaactgacaaggcacaaaacaaaccttccgcgggatgcggaaaaagaaaaaagcggcagcggccgcaaacatgtcaagagacataaggaggtacttatgaagagagtattagcgatggttttatgcgcatgcatgtctttcacattgcttgcaggatgtggaaacagcgggaaagaaacggcggcggaaacgccggcagcggcagagagtgcggcggcggagagtacaggggaagcggaaagcgccaaaccggaagcgtctggagagaaaacggtaatcacctatctgcgtccgggtaccgaggtggatcataatgcggagcttgtacaggccatcaacgataagctggatgccgacgggacaggcctggagctgaatatcatgtatattccctccgatgttttccaggataagctgaatatgatgctgtcctccggtgaggaattcgaccttttatgcattatggaggatcagaagcccttcacctcatttatcgccaatgagggaattgttcccataacggaatatgtgaatgcaagtgagaatctgaaaagagtgattcccgactatatgtgggaatcagcaaccatgaacggtgatatctataccattcccgccaactggtgcgaaacggcggatcagaacaactgcattaccataagacgggaaaaactggaagaatacggactggaagacccgcagaccatggatgatctgctgaatatgtgcgaggtattcacagagaattgggatggagacaataagcctgtggtaattccgatgttcaaagagcctttcacctatctgttccggacactggatacatatcccttcaccgtacagaaggatttgatttttattgaccaggaaggcaatgtaaagaactggatggaaaccgatgagttcaaacagtgcgccgaattcttcaggaagctttatgaaggcggatatattcctgaagatgtgctctcttcaggctggtcaagctggaacaccatgcttaccggtgatttcatctgggttgatcagtgccagctctgggatacggaagaggtatggaaggaaagaattccgggtgtcaacctggataccatttatctgaacaaggacgccaaacagttccggcccaattccttccggaatgataccgcagtttccgcgacttcagaacacccggaagaggcagttaagtttatggactgggtttattcttcccaggaaaattatgacctgatggtatacggcgtggaaggccttacatggacggatgaaggcgataaattatacagcaaaatcgatcccgcatttgaattcaatgctgactggatgattggcaacatggaatatgaaagatatcagaagggcacctatgacaagtttattgaaatcatgggagaagaaaagccggatgcagaaaacagcatcgtattgaatttcacctttgatccgacaaatgtggccgatgagtatgcgaactgccaggcagaagtggttcagagtatttatcctatcaagctgggtcttgtatcctatgaagagggctatgaagatgccctgtccagaatgaaagccgccggaatcgataaggttgtggaagaataccagagacaggtgaatgaatatttaggaaagtaaatcatatttccgcacagatgcggaatgcctccaggccgggactgcccggcctggttattggggagaaaaatatgacagttaccgcattagagggaagctataagctgaaatactacgattataatacctttcagatagatgaaatcatgaaaaataccttttatccggacgactggatggataccagggtgccggaggacgtcaggacggcgctgaaaaggtatggatatattgacggatattattatggcaaggatctggataaggaaagatggattgaagaaaaggattgggtatattatcacaccttttatgtggaaaaggaacgggaaacggaagaaaataccctttgctttgaaggcattgataccatagccagaatctggctgaacggcatctgcctgggaatgtgcaggaacatgtatctggaatacgcttttgatgtaacgcagttcctccgttatggtcaggaaaactgcctggtaattcaggtgctgtctcctcttggatatacgtcggatatatccagagaagggatttatccggaggatgataccaccagaatgcttctgcgtaagtcccagatgaactggggatgggatttctgcggccattgcctcacaacaggaatttggaagccggtgctgctcaaaagcagggatcatgcagtccttcatgagacacagcttatcacggaagggctggaaggggacagtgcggagctccgtctgtggtgcagtgtcatggattacatagaagaaaagccggatcaaacgattctgttggaacttcaggcagatggggaaaaggtatttgcaagagaactcacccgtaaggatgcggaggatttttcattttccctggataagcccaggctgtggtggcccagaccttatggggagccttttctctatgaggtaaggatttgcctgaggggagaaaacggggttctggatgaaagaagcttccgattcggcatacgcacggtggagctgattcaggagaaggatgaaggggggagaagctttcttttctgcgtgaacggaaagaggctttttatccgcggggccaattgggtaccgcttaactgtgtttacggagaaatccgggatgaggaatacgattattatatcggcaggattgtggattccaatatatccatgctgcgtatctggggcggaggtatttatgagtcggagcatttcctggatgcctgtgatgaaaggggtatcatgatcttccaggatatgatgctggcctgcgggatttttcctcaggatgcaggcttccttcaggaggtctttgaagaaacaggtgtcatcgtcagaaaaaatatcaacagaacctgtatcatgatatggtcggctgataatgagctggatgaagcttaccgttggtatgatatgctggagcggtttcgggaaaataaggtgaaccgggaggcggtcagaaaaggagtggaggaaaacgattcttccaggccgttccttgtcagctcgccctgcagtccctttgaacaggaggagggcggagaggatcccaattccgacaaacagggggacatgcatctctacctcacccgtttcctgaaaaatgatgagtattattataagaaaatattggaattaaaaccccgttttatgagtgaatacggcttcagcagccttccctgggagccttcctattaccgtttcaatttccggaaggagccggtggatctggtgcgcaatccctggctggctcagttggactggctgcgtgaggtaggagaaaaaggggatgtttcagaaatcatctactattctcagtttacccatgcacagggactgaaatactggatcgaatatctgaggtccttaaaatggcactgcggcggttctctgtactggaagtttaatgatccgatagctcccaacagggaaaatatgctgttcccttctctgatgtcctgtattgatttcttccggcttcccaagcttgcttattattatgcaagaagagcctatgaagataaaatactggcgttccgggaggatttggaaggcaatctggctgtttatggctgcaatgaaacagacagtattgcggatggaactctctgcgtttcactgaagacctacggaggggaaacggtatggtgtgatacggtgccgtgtatcatggacagggataatgcctctctgctttacaggatacctgcggaacgtctggcgggcccgtcctgctcctgttatgtgtacgcggtatttgccgcaggggaagaacggcttgtcaatctgttccaccttaccgaggtgggagagtggaaccaggtggagatgccctgtgcggcgctgaaagcggagcttagggaagcgggagataatcttctggaaattactgtaagcgccgattcctttgtgcaggatgtgaccattgaaatactggatgaggatgtttattattcggataacagcttctgcctggaaaagggagaacgtgcagtgatacaggctaaactgacggcgtccggaagggacggagggaagatgcggatcagggcttataatgcggatcctatctgcggcagcttttcactgggagggaacagaaatgaagtttcgattagataattggagcagggaagacagccgctgttttgacgaactggcagagcttctttccatggaaagggcagaggacggcataccgctgaggctggaggcggcggatcatccggggtgttatatgcaggagagaaaggcggtaatcacctattcctccagacatcagatatggcgggaactggggctgttatgtgaaaaactggaaatgcaggactgctttgcctgccgggaggagcccgcctatcaagatctgggtgttatgctggactgttcccgcaacggtgtgctgacggtggctgcggtgaaggattttaccagatatctggcgctgatgggctattcctctatccagctttatacggaggatacctataaaatagaaggacagccttatttcggatatcagaggggagcatacagcagggaagaattccgcgaaatggattcctatacgtctcttttcggaatagaactgattccctgtatacagacgctggctcatcttgagtgcatgctgcgctggaaagaatacgatgggataagggatatcgacaatatccttctggcggatgaggaaaagacctatgatttcatccgggaaatgttccggcagatggtggggaacctgaagagccgcagaattaatataggcatggatgaggcgcatatgctggggcttggaacccatctggaccggtatggctacgaaaaccgtatggacatcatgctccgtcattacaggcgtgtggcggaaattgcggaaagcttcggatatcagccgatgatgtggtccgatatgtttttccgtctggcaacccatggggaatattatacggaagatgagcttcaaatcgatcccggcgtcggggcggctctgtccgatgacatcactttgatctattgggattattatactttggaagaagaaaagtatcataaaatgttcgccagccataagaaaataacggatcggatcgctttcgcaggcggagcatggaaatgggaaggcccctgtcctaactcctggtacagcagggctgttgcgctgcctgcccacaaaagctgcagggaaaacggcatcagtcaggtgatgattaccgcctggggagataacggggatgaatgtccgttgtattccgtgcttccggcattttcacaatgggctgaattgtgttacacagactgctgtgacgattcccatatggagcggagattccgaacctgtacaggcgcttcttaccaggcgttccttcatctgggagatgccgcggtcatgccggataattcgcctcccgggcgctgcggggtaaatccggtcaggtacctgctgtatcaggatttgctggggggcctgtttgacgcccatgtggactatgagcaaaaggaatatctggaaaactgcgcccggctgatggaggaatacaaagagtcggctcctgataaatggaggtatctgtttgaaacacaggaggctatagacaggctgcttgccggaaaatgcatgcttggcgtggaaatacggaaggcttacctggaaggaaaaaaggaagagcttccggcatgtaaggaacaaataaccgttttgctggaactgctggaaacagttataaaagacgtacagatacagtggtgcagggaaaataaaatttatgggctggatattctgcagcagcagctgggaggtcttaaacagagaatgctctttgcctgcgacagactggacggatatgtaaaaggccggtatgatgctctggaagagctggaggaggagccgctcccttattacggtagagaaacggagggaaaagctgtggtatccccttcctggagccgtatcgtgtcggcaggaaaccattaatgccggaaaagggagcagagggtacgatgaaacaggttccgctttatgaacagatttacaggacaattctgagtgatatagaaagcggggtatacgccccgggggaaaagattccctcagagaatgatttggcggatatctaccatgtcagccggattacatccaaaaaggctatgaagatgcttgctgaggggaaccgaatcatacggctccccggcaagggatcctttgtagcggatgaaaagacctttaaaagaccggaagaaaagaatacagaacaggggtccaggctgattggggtaattctggatggtttcagtcccagctttgcctgtaatattttgaacagtatccaggagtcctgtgaggaaaagggctacagtatggtcctccgatgctcgggaggaagcctgaacaaggaaacacaggctattgaagagctggtgaatctgggtgtgtgcggatttattattatgtgtgtacatgatgagaattataatgaaaggatattgcagcttgtcattgagcattttcctgtagtgactattgaccgccagcttaagggaatttccgttccttttgttgggaccgataatgtgtccgcttccagggaactgacgggatatctgcttgagaaaggctgcaggaaaatcagctttgtcaggcccaaagcccacgaaacagtcaccctgatggacagacagtacggatttcagcttgcctttaatgattatggtctgatcgctgatgaagctctgtggatcacgagtctgtgttccacgcttcctgaaacgatgggtgataaatacctgcagcaggacattgcgattgtggatcagtatctcagagaacatgaggaaatagaggcttttatggccagcgaatataatctggcaaagattctgaaatattgcctggaaaaggcgggcagatataaagaagacatgatagtctgctttgacgggccggaactgtttctgggggaggcggaatttacccatgtggcacagggggaaaagataatcgggaaaatgagcatggaactgctgctgaaaactattcacggggaagaacgtccgggaacggtgatggcgccttacagaattattaaaagatatgaaagaaactggggattatgatatggagacacccaagatattgataaggaaagcggaagagctggaggcgtattatcaggagcattaccaggaggcggcgcccctggtaaaaaactgcttcctgaatacaatagaaactacagtaaaagaaaccggagatgactattttgtcataaccggagatatcccggccatgtggctgcgggattccgccgcacagatcatgcattatgtcaggtatgcgtgtgaggatacaaagttgcaggcaattatagaaggagtcattcgcagacaggccaggatggtccttacggatccttatgcaaatgcattcaatgaagcgccgaacggtaactgctatgctcatgatttaacggaaatgggcccctatatctgggaaagaaaatatgaagtggattctctgtgtgcaccggtttacctgatatatcgatattggaaggcttcggggaaaacagatatttttgacgggagaatacatgatatgcttcttctgatccggactgttttcagcagggagcaaaagcatggggaatcggcatattcattcgaaagaaaaaattgtgtggaaacagatacccttccctgcggcggaaaaggaaatccgacaggatatacgggaatgacatggtcaggctttcgtccatccgatgacagatgtatttacggctatctcataccttcgcagataatggcggtaaaagccatggaatacgcagaggaaatactccgtacggtttatagggaagaggaaagtgccggaaagtgcaggaagcttgccgggaaaatcgaagacggtataaaaagatatgggataactgagctgcccccttttgggaagatatatgcttatgaaacagacggactgggaaattatgtctttatggatgatgccaactgccccagcctcctgtcgcttccctatctggaatactgcactgcggatgatgaggtttataagaataccagggcctatattctgtcggaagaaaatccctgttatttcagcggaagtgtgattaagggagtggggagcccacacacgaaaaagggaaatgtatggcccataggtattatcatgcaggctcttacttccggtgatgcagaggaaataaaggaatgcatggatatgctgcttgccagtcacgcaggcactgattatatgcatgaatccatcaatgcggacgatccggaggattatacccgaagctggttcgcctgggcaaacagcctgtttgccgaattattgatccgggtaaaggaactggggatatatgatgccggcggaaaagggcagtgatcccgcagtttatgtatgtttataattctttgcagtaagagggaccgtcgcttgacagcccctcctttttgtatcagtccttcacaagaatatcagtgatttccgcaatatacagcagatgataacctcctccggttccgtccgcatgattatctccgccgtaccacttctgtgtaaattccttatccccgaggaaatcctcttccttcagcggcgtgacgcaaagctttttacacagaatagccatccggcattcttcaaaataaggaacttcgccggaatgggctactgtaagccctgattccttaaccttatcctggtcacggccggaaatggtcccgcagtagccaagcatcttccggtagctgttgtcgaataccgtgagtgaaaagacatcggaggcgtccaggaactcccgggtaaagcgttccgggcggactgcgcacatcatgaccggcttctgccataaaatacctgccgcagcccacgccacggtcatgggattgacgcgcccttctttttcggcagacataaggaaccagtctttgctgatcagactgaatatattttccgtcatctgtacgggtttgattgaatgaaatgccatgattcaagctccttccataagctgttgattcccctggcgggggattttatttaccggtttccagatattcctttaattcttcctttgtcatgccttctattcccaaatcctgaagggagtgccctttttcccagcagtcatagccgagaagggcagaacctattgtgatcatggactcaatgaccggcacatctacattcatggcccgggcgagctttgcccagggagccaggccataggggatatcttctgcatagtagcggctgttggtatcggcaggcccttttattttggcaaaattgggatcactggcaatcgcctcaccaatatcgtccgttacgattgaaccgccgactccgtgggcaacgatatcactggcgtagccgaagctgtccagcagtgcgatacgttccttgtcgatggcctctgtggtacgggcaacacagggggtaaagccctctgtatagaaataaaattcgccctttgcatattcaatccttcctgcgttcagaatgcagcccggaacatggatgatgggattcagactggaaagtccgcaggcgattacgctttccaccgcttccagagaaggatagaaggtgcggagcttctccacggtctcctgcgttctgcatgcaggcatcacaccgactttgaggggattaaataggctcataatcaacgtgcttccgggcccctgaaggcgggtggcatagggcagggtgtttgtctctgcaacgaccacatcctccagtccttttttcctgaattccttccagaaaataagactgtcgaaggtaccgggcatcaccataacagtctggccgggatgtacgagttccgccagcgctctggcataaacatcatgggcaaaggcgggtaccgccacaaatataaattccacatcctgtatggcctcctgcagatcggatgtcaccatgtcgattttgacggtggcgtttccggcagctcctgtcattgtgatttcgtgggtgtcaaaaacctttttaatattacctgcaaaacgcgcatcttcatacatatgtacgcaaaaaccgcggttggagagatccgccgcagcggcatgtcctccgtttcctcctcctaatacagcaacctttacagccatatccacacatcctttcatgaaaattaatattttactgtattcattgtaacgcttgcatatgaattacgtatcatataaaattgctatcaggatatataaaaagaatatgacattttttcatccggtcattgtgggaggcgtctatgaatcttcagcaattaaaatatgtactggccatttataaagaaggctccatcacaaaagcgtcccatgcgctgttctgtgcacagccgaatgtgagcagcgccctgaagagcctggaaagcgaactgcatatacgtatatttgaccgcacgctcaacggtgtggaactcacgccgcagggagaggcctttatttcctatgcggtaaatatcatggcgcaggtggagcagctggagaacatcgggaatgaatccgtggaaatcccggcgtccctggggatttccgtttcccgtgcctcctattgcacgcaggcgctgtcgctgtggatgaatgaggaaatccgtccggaacagccgctttcccttcatttctgtgaaacaaatacagagaaggtgatcgatcaggttttccgggcggaaagcgatttgggggtcatacgcattcccgctttttatgaaagctactacggacagctgctggcaaacaagaatctgtgccatacgcttctgatgcgttttcagatgctgctggtcatgcgccgggatcatcccctggcagggaaggcggatatcactccggatatgctcaaacggtacacggagatcgtgcacggtgaccaccgcaacccttccatgactatggcgcgcatcgatccgcttttgcaggagacgccgccgcggcggatttatgtctatgacagagggagtcagattgatcttttgaaaacgcttccgggcgcttatatgtgggcatcgcccataccggaggatattctggaggaagccggtatgattttgcgttccagttccatggcaaaggtctataacctggatttgcttatacggaggaaaaacagtccggaaaacactatggcgaagagctttgcatactatctgaagaagtatgcggaacggcttgcaaatgaggcagacaactgcagcgcagaaaaggaaatagagtgatgaaagaggagattttaatagttgaggatgatgtcgatatcagcggactgctgaagcggattctggaggatgcgggctatgagacgaagcaggcttattcaggaacggaagcgctgctgtgctgcgagaaaaaacagcctgatctcatcatgctggatctcatgcttccgggtatgacaggtgaggagtttctgctgacactgcgggagggcggctgtgatatccctgtattggtattatccgcaagatcgtcgcttcaggataaggtaactctgctgaaggagggcgcggatgattatatcacaaagccctttgagccggaggaaatgacagcgagagtggaagcggcgctcaggcggagagggcatcatgaagaaaaaagcggtgcaaaggtatattcctataaggatctgaagctttatccggaaggacgaaaggttcttgtattggacacgctcctttcgctcaccgcgtatgaatatgaaatattatttctgttaatccagaatcctgaaaaagtatattccagagagcttctatatgagcagatatggaaaggcggttactacggcgaaaacaatacggtaaatgtacacgtcagcaatctgcgcagaaaaataaaggaagccggagccggggatgaatacatccggacggtatatgggatcggctttaagctggaataatctttatcacttctttaaaagttcttaagtactatttataatccaatgcgatatacttcatttgcagcagggaagcgcttccctgccggcaaatgcctgaaacccctgaaaaggaggaaccgaatgaaagattttgtggtgcagaccaggcaggcttccaaagcctacggctctttttatgcgctgaagcaggtctccatgcatgtgaagcagggcgatatttatggactgataggcgacaacggagcgggcaaatcaacccttcttaagctgctgacgggccttgcccgggctaccgagggagaaatccggctttgggggaaatatgaggagaaagaactgaaacgctgccggaagcagatcggcgccatggtggaacagccaggtcttctgcccggattatccgcagaacaaaatctggaatattatcggatccagaaggggattccgggcaaaacatgtggagacgaggttctgaagcttgtcggattgtgggagcggagaacggataagtgcgggaagctttcgccgggaatgaaacagcggctgggcctggcgatggctatgctgggagaacccaggttccttatcctggacgaacctgttaacggtctggatcccagtgggatccgggaattcagaagccttatgcaccggctcaatgaagaaaagaacgttacgatactgatgtccagccatattctgtcggaactgcagcagacagccactgttttcggatttttaagccagggcaggctgctggaggaaatcaccgcggcgcagctggaagaacgatgcgcggactgcatcataatccgggtggtggaagcggataccgaaaggtatgcggcacagctggaacgttttttcccggaggcccgttaccgggtactggcggataaatccatacggattaccgggaaagacatggaagaagaggtggtcagccgtctggcctatgagaacgggattctcattaccgcgctggaacgccgcagatatactctggaggattattacatgaatctgaagaacggaggtgcgggggcatgctgaattatatgaaaagcgaaggctaccggatcttacacagcaggggcatgtatctttttaccggaattacggcagcagcggtattttttctgaactggctgctttcctgccaggggcagattccctatgcaacggcacatttttcgttggggatgctagtgggaagccccatgctgtattgctacatggcattgttggcagcgggtattatgttcggggaagacaagaaaaacgggatgatgaaaaatgctgtggtttacggcattacggggcctgtcatatttatggggaaatgtatggtgggagtccttgccgcggcctgcagcctgattgtaatcatgacggcttatgtggggagcgcccggctgttcctgccgatggaggaaatggaactgagggccgtgctggtggaaattccggcgatgtctcttatcgccggggcggcaatgatgctggggattcttgtgcttgatgctgtggaaaagacggcggcgggtattgtggtgtggttttttcttgtgatcggcatacccagggggctgctgtatctcagccatgtgctgcagtcggagcttctgaaggaagccgcgctgcttttcccggaaaatttcctggcagaggaagtcagggtcactctcggcggatatgccatattgtgggatacacctcaggggatgatgaaatgcctggtatccggagctgcaggaattcttgttttcactgcggcggggatacttgccttcaggaataaagaattgtgagaaagggttacaggatggcagaaatgccgtattgggtaaaggtagaaaaatgatatatgtgatattggcagcattggcgttggcagctatctgtttcagcatccgtttttatgccctgaaacactctattcgggaggcctgcagggaacttgaggaaatcaggaaggaaccggatcaggatcggatcctgcacatttcggtgcccgacaggagcatggaaaagcttctgcagtccatgaatcttaccttgaaggaaataaggtcggaggggcagcagtacagaaagagagagaaacagtttcaggagcagatagaaaatatcagccacgatctgcggactccgctgacggttatccttggctatctgaggctgctgagggaaaaggaaggaacggaatataagggagcggaactggaggaaatactcggcttaatggaacgcaaggcccgtttcctggaacagctggtcagccggttctacagcttctccagactgacagcaggggatttccggctgaagctgtgccggattgatgcgggaagaattctccgggaaacactgacggacaattatcgtgtgctgcaggagacccgcctgactgtggatgcggatattccggagcatccggtctggatatggggagagcaggaggcgctggagaggattttttccaatctctgtcagaatgcgggccggtatgcggagagtttccttcgcatttcggtcaatgaaaaaaaagaacagacggaaatttattttgagaatgatacaaatagaattacggaggaagaggcagagcatctttttgaacgttttttcgtccctgacaattcagaaaaacaggggagcacagggctgggattaaccatagccagataccttgcggaggccatgggagcgtcgctggaggcggatctgacaggcgctgcgggcagtgaaacgggaaaaaaagggagtgcggcaggagtgattcgcttcacgcttcgtttttcaaaaggacagatccgtgcaatatcggaaaaagactaaaaataagagcagacaggagaaaaatttcgatgaaagcaaaaaacaggaaagtaaaacgtatgacagcgatttttatggcggcggccatgagtatgacactgctggccggctgcggcggcaaaaccctgacggaggaggagctttccttctgtcagacagatgtcggaacgcttacggcgccggatcatgtaatgatagtcggactgggggaatccagtcatggagcatcggaatatcagcagatgaaggctgaggtatttaaggctttagtgaataataacggatgccggacttttgtaatagagggagattttggcggcgggctgaaggtggacgcctatatccatggcggagaaggaaccgcgcaggaggcggtggcggagcttggtttcgggatttaccgcacaaaagagctggccgaactggcggattggatgcgcagctataatgcggaggcggcggagggccgggatcttcatttttacgggatggatatgcagagatacgataataataaagaatatctcttttccgtattggatgaggcggccccggagctgagtgaagaatataaagagatattttcacagctgacggatgataaccggtacgtattggacaatactgcgctggaacaggcacagactgatgccctggcgctgctgaaggcgatggatgaaaaggaggaggaaatcacagctgtttcgggaaaaaggaatttcgcttttgccagagaatgcgcaaacagtatttatgaatccagcgagctgtgtgccagcggaacggattacaattccctgcgggatgggcatatggcggaaaaggtggaatggtttgtcagccagggcgacggcagtctcattttcattaatggacataacgggcatatcggtaaaagttcggtttcgggctatacctgccttggcgcgcgtctgacggaagcctacggggatggctatttcgcaattggaaccgacgctgcggcaacccggtttaattcacagaaagacagcggcggttttgaggttatggaagtaaaaaataaaaacgatctcaacagacagctggataagcttcaaggtgattattattatctggatttttcggaggtatcgggtgacagcggctggcaggaaatactgaattcttcacagaaaataacctcattgaatgtggggattgcaggatggcagaagatttcgaaaatgttttatacacaggcggtggttccttccgcagattttgacggtatgattgttttcagggaggtttctcctactgcgatagtggattaatacaggatttgtattttgaggcggcagcaccgttgacgggtgctgccgttctttttttgggtgcccgatttttattgggcagacatatacggctgcaaactaagttaatacagatgaacaataattcggctgtaaataattcatacggagataatggattgcatgcggtaatcacacagagtataattaacgggatacgatattgttcccacaggggaaccggatagaaaatattggggtaagtgattagaatgagtgaagataataagaaaacgaagaaaacaggaaggataatctttacggtaatactgagccttggcatagcagctttagccggaggggccgtactttaccgtcagttcatccttccaagagactttgactggctctttccgtggatggaatccgcagtattcgcaggcctgttcctggcggtgttctggattcttttcctgtggctgccgattgggaagaaggaaaagtggcttttattcggaagcagtgttctggcagctatattggccgtagtatgcattgcgctggttctgcctgaaaaggtgagcatacagagatcacccgatcggaaatatacgcttgtgacggtggaaaatacggaaaagcagacaacggccgtttaccgtatttattatggggtactgaagagagaaaaggagcagctgccgtttcttccgcagacagcattaaaatatcaatggctgcagaacgatgtctgtgcagtcaccggcaggaatgaagccggtgaaatatgccagtatctggcgacctatggagagcggggagatggaatttcttatatagatccgctggcggccatgcacggaaactgggaggctgaagtggatggggtaaaatgtaagctgagcataggcgggacggtggaactggagctgccggagattcgggaatcttttgacagcagtgaatgtgaacggtacggaactatcgccgtcacactcggaaagggtggggacgcgcgctggagtcttgttatgaatcaggactgcaggctgaatgacggaagcattgcacagggaggaacgctgacactttgcccggtatccatggaaacaacatccggagatgaaaaatctccggaagcgataaatcccattatatggaccagtacggatgaaagagaggcatggatcggaacagaagctgtacagggggaagaaaaagaaaatgtaatctgggttaagctgaagcagtactttggacaaagagaacaagaaaagcaaagcccggaagaatctatcattaaggaaatgcgttccctggcagaaagcaatccttccggggaggggtatgagccgtcacagacaggaatcttttttgtagaaacgacagatgcggaagaatgctggaatgtgcggaatatattgaaggaatttcaaagctgttaccagataaacggggtggacagtgccgttcagattgactctgtccggtgtcttgcgggggatcaggcagatggactgtatgaggtgaatacggcggaattccttgtttcaccgggaattgcgggacaggtggcggacggaagtttcatggaaatgagatatgatttccgtctggtaaagacaccggccggatattacgtttatcgttttctgaatggaatggacggcggatgggggctggaaacagcggcgggagaagcttataaactgtcggacaaagaggaatactacttttacttgccgggggaatatgatacgtccgatatgtataagtttgccaaatcaccggaagaggggatgaaggaactgtatcaggcagtgctgggagagcgatatccgaacgcttcggaagcggtttatgatggcttcccggccatgcagctggatgattccggtttgctgtttctcctgtatgacgggatcacgaaggactgcctgcattaccgttaccgggtggtgagttcacagacgccggggctgcacagatacggcagacttgagatacaggaagcgtatcaggccgcgataaagaggggaatgtctgatattgccgcggcggacaggacggttaagatggtaagggcctcagaaacagaacagtcggcgggagcggaatcgccggccggaacgaatccggcggacggaaaagcggaaaacgggaaagacgtaccggttcagggaaaagaaagcagcgggccaagggagggtgaagaattatgggatacctataatggcgactatgccagggaaatatctctgaaggaacaggggataaccttccgcatggtggagctggatgctgctttgggcagccggttttatggcctgataaaaagctatgacggcgggaaaagctggtataaggtaggaaaggatccgtttcactcccagaccggtatggatatcgactttatctttttcgatgaggatttcggatttgccgcgctcgcccataatggcggtgacagcgcagatctgtatgtaacggaggacggaggattttcgtacagtattgtgaaaatggaagaaaaattggtgacgctcgacggggactatacctatgcgccctatgactatccacagatgccttattgggaaaacggaacgctttatgtcctctgcggtcagggcgccgacggggattatgacggaggcgatgcgtggacattggcgcggtaccggtcggaggatcatgggaaaagtttccggttcgatggaattgtgcctggaaccggcaggtagtgggggagggcgagttatggtataggaacgccgcctgtgcagtctctccctggcatcctctgccgcctctcccaccgcgtacactctgcccctccagtgccagacaaaaaaaggcggctgtttctaacagttttatttctatactttactgccaacgcggcttaaactcctccctttggtcgtcagacagcgccgctaagggcgggcagtaaagtatagaaataaaacagtaagaaacagccgcctttttttgagatggcactggaggggcagagtgtacgcggtgggagaggcggcagaggatagcggggagagactgcacaggcggcgttcctataccataactctgggaagtacgggtgagatggatatgtgctttgaggattaaggggttattggattaggcggagcatggtggatatgtcttcggaggccatttgggctttggatttttctatgaggatgttgcctccggttatgatgtaggaggggatgatccggatggtttcgtagtagagttcggtggttctcagtttgtaggttgaggtggaggggactgcgtttttgccggtggcttttttggttagcatgttgaaggcttttttggcgacgtcgcccatgagcatgattactttggtgtttgggaagagggaaagttctttttctaaatagggcaggcttgtttcgatggtgcttctttcaatggtgtaatcggattttggggttttgacggcgtttgtgatgtagatgcctgtttgcaggatgtcctggatgttttgggcaggaaggccggctttttggaagagggggattgttgttttgaggtaatctgggtcgggggaagcgtaaaaatcctgggaaggatcggaggggactacctcgtttatcatgattgccttgattttctcaggatcaaggtctaaatcgttcagttgtacggggagggcggcgggtattgttttttcgagttctgtttttatgttcattttttctcctgtctgtgcgtttctgcacgcttatggccattggcggctgtggggctgaaagggttttttcagcggttacgtttctttgtagtggttcagggcggcttcgtatttttggatgattttctgtttgatgtattgggggcggatgatggttactttttcgccgaaggacatgagaaagtcgtagatccagtcggtttcgggcaatgtcaggttaacggtgtatccgtgctgtgtttgggtgatggcgctgtcttccagcaggtcatacagtttaaagccgacttcaggaggaaactgtaattccagattaattaaaggtctcgtatcctggggctgggaagaattgttttggtctgtttcggggattgcgtcaaaatgtgtttcggttaaatgtaaatgtttgatgcgggtaaagcggaacagccggcagtcattgtgcaagaggcagaacgcatggaggtaccatgctttatctttgtaaattagtttctgcgggagggcttcgcgtatgctggcggtgccggaggaattgaagtattcaaagcggattttcctcttttcgaggacggcctgtttcagttggataaataattgattttcatattcagcggcacttccccagcgtgaaaagtcgatctctatccaatcggtaagtcctgtttgaaaaacggcgctgagttttctcaaaatattgtcgatatcaggatattgtacggcggaaaggctttgtatggctgataagatttcctgtttttctccggatgaaaaaaaggttttatcaagaatgtggccgtcgagaaaacggatgccgccgtttcttcctgtggtaacgtaaatgggaatgccggcgctgctcattgcgtctatatcccgatagatagttcttacggatacttcgaatttttcagccagctcaggtgcggtggcttgtcctttgtccaataaatagtataaaatccggaacagtctgctttcctgcaatcaatcacctccataatgctgatatgattatactataaaaaccctgacacgtgatggcaaggtttttatttcagctgtttccgttttcatatatgatttcttccatcagtattcccatttgttccggtgttttccggggattttcttcgcaccagatgagtgtgagccgccagaaaccggccaggcggaaatgaaaaagatacttatatttttccagatcggcagaaggcgttatccgttcgtattccggggagatatgttttatttttaccgcagtatcgcggacgagggcaggcatatcatcctcgaggaaatacagcaggtgctgttttttcagaaggaggaggatatcaatatagttttcccagaattcgaaatatgactgcgcgatgcctttcagatcggccgcatggtttttgagcagggtattggaaaattcatccatgagcagagatgaggtatatttcatcacatcatcttttgtccggaagcagcggtagaaagtcctgcggctgatattggccttctgtgcaaggcggcctattgtgatgtcgtgatagtttttgtgttcaagcagttcgaacagcgcttttacgatgtattggcgcggctgtttttgttctctgaccggtattttcataggggactcctgttctatggatttctttctgtcagaaacttctccagggcggatagatatgtttcacggctcagcagcattgcgaggtgtccgcctttcaggccggggacgacggcgggctccggcatcaggcggatcagagcatccttcaggctgtcacagaatatatggtcttcctgggaaaagaaaagcaggacttctttgcggaagggttcgaagtcttccggtttatgggttccgaattcggtggtcagatctcccagaagggtatccatatggacaagatagtcattagagaagtcttttttcagaatgtcaaaaacagcgccggcgatttcggccgattgtttctctgcgatggtgcgtctgcacatcagcttgaagagggggaacaggagaaacatggggaggtatttatccattctgatatttttctttattttatccgggttaatcatggttacaatattctgcattccttcataatcaatatcgttggacagggaacaggtacctgacagaaccattccctttatgatttcaggatggcgttttgcggtgatctgtgccaggagtcctccataggactgcccgatcaggtagatattccgggcgccgatttgttcgaacagttcagccatggcatcgcaaagggaagcatttgtggggaaatccatgggataattgaaggttataaggctgtatttgggaagaagggaatcatacaggtagaataaactgtcgccgagcccggttccgccggccagaaatacaagggtgatatttccggatgggctttgactgtttttgtagtatcggtatgtaaagctgccatgcgtcagcctggcggtgcgtaagggcgctgttttatcaaattgtgtgtatttctcttttaaggtcatggcagagcctccttatatgaattggggattagaagaaactaacttccggataaaataaaagttgttactgtactttggaacctatgaggactgtggaaaatcgagccggggaacaataactggaaagcagcggggcagaaattcttttttatggatttgagatgggtacagtatactatatgggaaaattcttttcaattatcagggataaaggcggcacagatttttgattttgtgtcttttgtttcatgatgggttgggacagggaggattcgggtttgccatttttcttacttgacacgagaaattgattataataatgttaaaggtatcagtgttattatgatataataaggataacggatatgagtacataatacgcatgcgcgggcaatatatcaggaaaatgaagtgtttgtatgataataaagagaaatgcaggaggaatttatgggtagaaacagcggcggcggaagccgcagaacgggaggttcttcaggaagcagttcctcttctggaggaagcccttcttcaggaggccgttcttcaggaggcggtcggatcagcggagggagaacgacacgtatatcttccggcagcagttcttcatcggggagtagccgtccggcttcaggaaacagcggttcttcatcggggaaccggtcttcatcagggaacagcagccgttcgtcatcaggcggaagcggccggtcgggagcaggaagcagccgtatatcgtcaggaagcagcacagcgtcagggagcggcaggagttcttccggtttctcttcggggaatacgtcatcttacgggcgtgaaagccgtaagtggggggcggccccgccgcccggccagtctccttataacagaccgcctcagtataatggctggaataatggcggatacccaccgccgccacctggaggaaatccgccgcctggaggatatcctcctccgcccggaggaaaccccatgccgccacccggaggatattcatcaccgccgccaagggtatctagaccgcccagaccaccgagggaaaggtggttccgtaacggttctggttacggcggcgtaaggcctgcccgttccatgggatgtcttggaggctgtctcacgcctttcctgattttgtttgtgataggaattgctgttgtggtgattgtttcttcgggcagccggaaatcggctcctagtggaacccgcgagcagcagaatgtacaggaacaggcgccgccgcccgtacagcagaaggcggaaacggagtcaaacgatcagtattcagaggctgcggtacctaccgtggcagagtactttaccgacaagatggggtggattaagcaggctgatgtactgaatgccggaatggaggctttctttaagaaaactggtgtaaaaccgtatctttatcttacagataatatcaatggcaatacagagccttcggatgaagagatggatgcgtttgcaggtgatctttatgataagctttttactgatgaaaatcacttcctgctggtattccaggaatatggtgactattatatgacatggtatgtgtccggcggtgacgccgctgaaattatggatgaagaggcggcaaatattgttctggattatgtggatgaatactacagttctgatatgggtgaggaagaatacttcagtaacgtattctccatggccgcaggtaaaattatggaaactaggccataagtactgtttatgcaagtgaacagcgagccagacggatgcgcagttctttttgcaattgcagcaggcagagacggaagacagctattttccgtctctgtcttattttaatttatttatatggaaaaactcagggagcagatgcatccatcaggatactgtcagatgccatatcaggataaagcgtggcatccagctgaagttcgtctttcagccgttttattaccgtattctgaatggcagatgcttccgcggagcggggagattcccggaaccttactttgataaaggccagtttttcttccggaccgtaatcatgcaggttgatgtcttccacctcttcaaaaagcgtgtattccgagagaagctgccggattttccgttctgtttccggagtgactccttttccgagaagaagtacgagattttctttgaaggaagtaaagcctgaccacaggatagaaaaggctacaacgattccaagaatgccgtcaagaggtacgctggtaaaagggatcagcaggattccggccagagttaccgaagtcaccagggaatcggaaagattgtcgttgcggacggccctcagtgcggcggaatcagccgctttattcagccggtttacataccaggccatggcaagcttgagaaggatacctatgattaacggcagtattatggatggcgagacgaggacattcattgggtgaagaagccggttcagggaggatttccccacagatacggcggtcagcagaatgaggatggaaatcagaaatccgcagatatattccatgcgtccgtggccgtaagggtgagtgcggtctttttcccttgccgccagggtgaagcctgttatggttaaaagggaagaacagcagtcagtaagattgttcagggcatccgccgtaatagctatactttggctgaaatacccggcgataagttttatcagaaccagcagcaggtttccgccaagcccaaccaatccggttttgcggccgatgagatcacggctgctgtttttttcgtaaaaaggaaatatttgttccatagttttgcgctcctttcttataatgctaggtaccttgtgaattacaacttatcacttatcagttaaaatgtcaaggtacctaactaaaaaagttgctgtgcatttccacacgccttgctatatattttacttgacaggctagtgaatactagctattatgaaaatagctagtattcactagccggaaaggatgtgtaaattatgaaggaatataatctggagtcctatttaagcagaggtgtggccaatatagtaaagggaattctgaaagcatctgccggaaatccgaaggaaagctttttcctgatgcagtatgcaaaagaaagtctggaggccggcaggctgaggaaggaggcggaagagcgcggggaacatatacctccgttcctgattgccagcattacgcagcagtgtaatcttcattgtaaggggtgctatgccagagccaatcacagctgctttgacggcgcagtccgggagaatctgacggcaggacagtgggggaatatttttgaacaggcagctgagctgggaattggatttattctgctggcggggggagaaccctttatgcgccgggatgtattggaagcggccgcaggacagaaaaagattcttttccctgtttttaccaacggaaccatgatagatacagacttccggaagctactctgtgaaaacaggaatttgattcccatactgagcatggaaggaaagaaagatacaaccgatgcacggaggggaaagggaacatatcagaagctgcggcagaccatgcaggaactgcaggaaaacggtattttattcggggcgtcggttaccgtacagaaacaaaatatgcaggaggtgctgtcccgggaattcacagaagctttgtttctggctggctgcagagcgcttgtttatgtggagtatgtacctgcagatcgcagctccgccgatctcgcgccggatgaaaaggacagagtatacatagaagacaggcttcgtcagctgaggggaacgcagaaggagctgttattcctttctttcccgggagacgagaaaagctcaggcggctgtctggcggccggaagagggtttttccatatcaatccgacgggcggagcggagccgtgtccgttttccccttattcggatacgagtcttgcaaatatttccctgaaggaagccctgcagtctcccttgtttttgctgctgcgaagcagcgggaatctgatgcaggagcataacggcggctgtgtgctttttgagcaggaagagcaggtgaagaagctgcgggataaggcggcagccatgtttccggcaggggggcgtatcgctgccggcaatgagaatggagagaaagaggcttgggcatgacgacgaaagagagaatagttcaggaagcgcttaacctattttccataaaaggatttaaggggacgagtgttaaaaatatcgcggatgaggtagggattaaggatagctccctgtataaacatttcggcagcaaacaggagattttcgatacgatagtcctggagatgaaacagcgcatgagccggctggcggagcgtatgaagctgccggaggaagaggattatgtgaaatcggcacaggcctatggggcgctgtccctggaagatctgctcgccttaagccggaacatctttcttttttatctgaaagatgattttatgtcccggttctggcgtatggcgaatatggagcagtatcagaattcagaggtttatgagatattccgccagatttttatggaggacagcattatgtatcaggcggagttatttggtgaaatgatgaaccaggggatttttgtgaaagcggatcctgtggctgcagctatgaatttttatacgccgatttttttcctgctgagtaaatataacggcagagaggaagaggaagaagaggctttgaagattctggataaccaggtaagggaattttaccggatttaccggtgtcaacaatgaattttcggcttattatgttctgaacgacggcagattgcgaaaaagtaaaaagcagatgatagcagatagaaaaatttaccgggaaggaagaggggcgattcgttttaccccgcttccttttctgtttttgttatttgaacctattttaatgacggcagtcctggcataacggtttaattccaaaaatcttctgtttctttcaggataacttcggtcggcaggatagtcgcttcgtaaagatttttgcccgtcttttcaagaaaatggcggattaaggcatatccgcatgcatagccggcacagtatggcattccaacaggagtgccgccgcgcatggccatgatgtcatcgccgtacaggtaggaggaaagaagctggaaatcattttcctgtaaatgcgcttttatggcaggcttaattacagtcctcagcgtttccgcagaagtgttttttacccatattccaatcttatcttctccgtaaagacttgccgcaaagttttcggcaaggccttcggataccagcatatcagccagagtaatggagggactccactgcatgaactgccatctgacattatggtttgtctcgtgggctaatgccacaggcagcatttgcatcgcgtgttcggcagggataatagtacctgtaaggtaaccggggatgccgccgtctccgcagtagtcaccggtcatttttgacatgggattttccggatcgttcaataggacggtaaaaatataatcctgtacaggaagtttgattccatgctcttcaaagccggaaagggaagttcgtatgctgttttcacagctttcccagaaggcatcatcgctgatcctttcgatttcgggaaggcgggcctccgtaatctgagagggagaatagccgccgctcataatgcctgcagagataacatcacagccaccttccttctccgctttcagcggaatccccatacaattccacttgaatgcaaagggttccattaattcataacggtaaatattatctttttcctcctttgatgcgcctgccattctgcggtagattgcgtcggaacggattgcttttatattcataatcagtacctcgattcgtaatttagtattgggttcgaaccacaagaataccctacactattacgctgcgtcaaagtcaagctttttgcaggaggttgcaggaggcttataacatcattttgaattgaataaacgaatataacagaatgataaacagaattatttgaatttttggcatgttgtatgaaaaaaatatatgagtaaataaaatgagaaagcaatttgcataattaatgtgcaaaatatcttgttttactttgtgatgtgtgctattataatgatattgataattattactgattaagaaaggaaggtattttatggagaacaagaaactgaccaacgaggttggggcacccgtatcggaaaacgagcattccctgacatcaggcccaagggggcctgtagcgcttcaggatgtctggctgctggaaaaactggctcattttgacagagaggtcattccggaaagacgtatgcatgccaaggggtggggcgcatacggtacatttacctgtacccatgatatctctcagtggacgaaagccaaggtcctgcagaaaggggcgacaacagaccttttcatccggttttccaccgtggcgggcgaacggggcgctgccgatgccgagcgtgatatcagaggagttgcggttaaattttataccgaagaaggcaactgggacctggtaggaaataatacccctacatttttcctgcgggatgtacataatttcccggatctgaaccgggccgtaaaacgcgatccccggacgggaatgcgttccgcacagaataattgggatttctggactcttttgccggaaacattccatcagaccactattgttatgtccgacaggggaattcctgcgacattccgaaatatgcactttttcggagagcatacctttgctttctataaccagaagaatgaaagggtatggtgtaagttccatttcaagacacagcagggaattaagaatctgaccaatgcggaggcggaggcactgattgccaaggacagagaaagccacggcagagatttgttcatggccatagaaaagggagattatccccgctggacgatgtatgttcagatcatgacggaggaacaggccaggaaccattatgagaatccttttgatataaccaaaatatggcgtcatgcggaatatccccttcatgaagtgggggtgctggagctcaaccggaatccggaaaactattttgcggaggtggagcaggccgcatttacaccggcacatgtagttcccggaatcggcttttctcccgataaattccttcagggcaggctgtttgtttacggcgatgcacagagataccgtctgggagtcaattataatcagataccggtgaaccgtgccaaagtggaggtacacgattatcaccgcgacggtttgatgcgcaccgacggcaattatggcgcagcaccggcgtattcacctaacagccagggcgaatgggcggcacagccggacgttatggaaccaccgctgaatctggaaggcgcgctgtatgcatatgatccccaggacgatccaacggatgactgcttccgtgccggcggtgatctctggcgggtaatggaaccggataagcgggatttgctgattgagaatacagtggaaaatatggaaggcgtgacagaaaatatcaagtaccgccatgcggttcattgttactgggcggatgaagagtatggacgccgcatgacagccggccttggactggatatggaaaaagtaaaggaattggcggcgggaaaccataagacattagttcaggcaacgatctgataagcagcctgtgatggaacatccttattgtggattatctgctttgaaagagaaaccgataggcaggatgtcccctgcccgctaaaaggtaacagaagtctgtacttacaaatccttgcattacctttaaaacaggtttgcaaggatttgtccgtatcagacttagagggggtttaaatatcccccgaaagctccgttttctctatgaattcccggagagtaccggctctggcggcttccttatgccattttttcaggagggtaagattagtttctgagagaatccgtttgcgtaaggcagcaggtataacgtccaaatcctccagaagttccagtaaagtgtaccccttgtcaaggacaaatttaagaagaagggatactatgttctgaatagatattgttatatttcttcttccttttctggttcatttattattcctctaagaggataatttccagttgttatatattggtaatactcatttggagatagctttgccaactgccattgatatctctcattattataataatccagccagtcatcaataattgttttaacctcttgaaagacggcgcaccggcttatatccacctcatctttcatatggccaaagaagctctcctgtggtgcattatcccaacagtttccccttctcgacatggactgtctcaatcctctatcctttactaattgaatgaaactacagcttgtataatgacagccctgatcgctatgaattatggcttcagcacttaacgacacaccgtgtttttctaccatccggtttactgtctgtagtacaaaatcaacttccagtgattcgctcaaaacataagacaatatctgttttgtaaaagcatctaaaattgtagacagatagcaaaatacaccattataagggatatatgttatatctgtcagcagtacccttctcgctccataagctgtgaattgtctttttaccagattgtctgcgacatgattggtctttattgcttttgccattcttctatatggatttgcagctcttattttacacacaagtccatactttttcatcaatcggcggatcttctttacattcataattatgggtggattttgatgtatcagcgtcatatagatgctctttgcgcccttatcatatccacgtttagcatacgctccaagaattatttcaaaatctgcctgatcttttaattccttcctctgtctttcatctgcggcccctgcccagcgatagtatcccgatcttgatactcctgctatatcgcaaagcattgtaactgataacagattatcttctttgcttactaatccgtatataatctcaaatttacagtccgattcattcatcatccgtctttctgctttgagttgtctgcttttataattttttttaaaaactcaacctcctgacgaaggtatagcagctcatgctgcatctgatctaaggatacttctttttcatgatttgagtttattcgtttcatgggaactcttttggttcgattttctccctctgtaaatccatctccagatagcgcctgcttctttactctctgcacaatgctgtctatctgtttttgttgaaacagcttagtgtcataacctaaatcagctataatctttctcggggcatctccagcctggtatcgtatccagaaatcctctttaaacctggctgtgaaatacagtttgttctttgtgacattcagggtatacttattttccttaagttgcttcatctggtttactgtgtattcccgcatatctttctcctttagatgtttttattatatatcaacatctatcagagataaagaacccccttttcaatctgtccactttggagggggcatcccttcttcatagtgtccattttcaaggaacccttcttcttaatgtgtccacatctatgggtacattataacagaatggcctcggctgtcccttctgcctttccttccgctctcccggcttctactcctatactatattcatcggcacggatttttttcaattcttcttcttcgttgtattcaaatatcgacatcgcaatcacctccgccctctgcgcggataaaaagtccgccagtatatcattacgtatacattccgtcaccgcccggtccacggcttccgcaatatccatctctgccgcatattttcggatgcattccacaaacaggcagtattccctgagagttctgcatttttccatcagttcccggttattcccgagattgatgttaagcattgtcaccgtaacctccagttcgggggaggatacctccttttcaaatgcatcggacagctttaacagcctgatttccggctgctcctgcgtcccattatagaataccacgaagcggggaacggggatttgtaccagattactggaatagagtgtctttccgactacatacttttccagctgcctggcaatataaaggagatcccgaagcggcatattcgggttaaaagaggactgatgctcgtataaattcatttccgaatcaaacaggaatgaaacatcattcttaaatcccatataaattgcgttttccagtgtacagatctccatatcgtcggtattttcatatgcggttccgttaagtgcattgtataactccaagagtttttccttatcattgtacagcatacgaaaaaccgtatccttgtggttcctcaccacatgcggttcctttccttctatagaataattttcttccatagacgtctcctttctaaaattgtgcgcaggaaactgtctgaaagaacaggacatatacatcctctgttcagcaccccctgcttgtttaaaatggattgtaagcatagagtttctgaatagaaatagaaaatagatggcctgagcctggattattagaaaattatgcttgcctttactttaccatattgttatcaattctgcaataataagagaatataaaataatttatttaaaaagattatttcattgcagtccagcagtcttcaagttttctgtgccgttggccttatggttccgcctgcccccgtcttccctgccctgtctttctgtacggcccgcggttctgcaaggttcctgtcagggcacgctttcgctcggataaatacgcagcggtactaaggttgcaaaatacgcaacctaaggaccggcgtatttatacggcccatacaggaatccttgcagaaccgcgggccgtacagaaagacagggcagggaagacgggggcaggcggaaccataaggccaacggcatagaaaacttgaagactgtcggcattatttgcttctatacagtccgcatgctttggcgtaaaataagtctataaccggctgtttcaaagcaggtcagctcaggctgtcacgaatatatgccgcagaggaggaacggaagtgggagaaagaaagggaatatatcagggaatgctttgcaagattctgctgctgtctgcggctgccgcagtcctggtagggtgcggcaggcaggaggaaccggaggtgacggagctgaccttcatccatggctggggagggacggtcaagacacactccaccatgcaggaaatataccgcgcctttgatgaggagaatccggacatcgtgctgaactaccagccatcctccgacagctatattgctgtggaacaggccaataatatgctcgccatagataaaatgccggatattgtgagcacaaacggacagtcctattatgtgcagaatgcggtaaaacgcggtatggcgctggatcttcttccctatatagaagcggatgaggcttttatccggagtatccacccatcggttttggaaacctggacggaggaaaacggcggcctttataccgtgccggatgcgctggaggtgatgggctactggtataatgcgggatatttccgggaagccgggattgtggacgaaaaagggaatgccaggcctccgcagacctgggaggagttccgggaagcttttgcaaagctggatgcctggggcgaagacagggtgaatgagcggggagagggcagggtagatacctgcgcgctggaaaatgtgcaggtggcggaaaatctttttcttgcggtattagcgggaaaaggatcggagggactgcagatggccggggcgctgcctgataccttcgacacgccggtgtttcgggatgcggttcgggagttctcctggattttcagccattccctttcagcggaaagtctggacgatgcgagggaatatttccgggagggcaagacggcggtttactttaatggcatatgggaatgcgaggaatttaaaggctgtgcggccgagacggatattgcgtacgccaactatcccaccgaatccggggagagcctttcctatatttccccatcctccggctatgtccttttcgacagctatgatgagaagaaaaaagcggcttccgtacgctttttaaagtatatgctcagtgaagaggtacagctgaagctggcgctggaaacggggcaggccccctccaaccccaatgtggatctggcggtaatcagggaggaatacccgctgctgggaaatgcgctggagcaggcgcatgcggcggacatccagattaagacgatcacaagcgtatggaacagcgggatcatggaaacaatcggtgcggatattcggcgcgcctgtatggaggaagaggctctggattccctgatttcagccctggataaaggcctttgataagcaggctgaaagttgaatgagaacacccggctgatatgcggacaaacaggaactgtttctgaaaaagatgttatttttttactgccctgccctgtaaaagggctgccggtaaaaaaataacatcttttttcatttaactgtggcagcaggtgaaaaaataacaaaattgtctgcggctttgtttattcagaacgaacctccgacatggtaaattgtaagcatcaggaaaatgcagcggcttctgttcgcagaaaggaaccggtgcagcttcgttaccgaaagggaggaaacaaaatatgaaaagaaaatctttaacatggatgctttgtaccgcaatgacggctttgcttctggcaggctgtgggaacagtacggaaacggcggattccgggcagacggcgcaggagagtaaaacggcggaggaaagcaagggggaagacagcgaaccggcggaacccgcagccgatgcaaatgcggcagacggggagcttcccaccatcacctttgtccatggctattatcatgacgaatcggaatgggcggcagccgctgagatgcgttcgatctaccaggaatttgcggatgctcacaaagatgaattccattttgtgatacaggcggatgaaacaggggcagaagggatttataacacggcgctgaacgatatcagcgcgggagaattttacgatattgcggacttcggaggctgggatatcaccccggttgcatctgcggcggggatgatactggatctgaagccctacctggatgaggacagcggttttaaggacggagccggcgtctgctatgaacagaatctcacggatgacgggaaaatttattccgtgagagagcagatcgaaggcgtgggcttctggtataatgaagcactttttaaagaggcgggagcggatacgccggatacatggaagacctgggatgattttaatggggcggtggataagctgacggcggcaggtatcatgcccttcggcctgaatgcgggatggcccactaatatccttacggcggcttatcttcagaggagcggggattccagaagcttttatgcggaaggaaaaatgacggagagctttaatcagccagcgtttgtggacactctttcttttatacagaaaaatgccctgcagaaaattgattccgctaatttcggccctggcggagatgatgacgaggcctatcgttccgatttctttgccggaaaaacggcaatgctctttaacggggtatgggatgcaggcggatccgtagattgtgaggcaggtgcagaaaacatcaagcctgcggtgttccctacggatgaagccggcaagaaagcggcattgctgtcaggcggctgcggttatgtggtatcctcacagctggatgaggcacagacggcggcagcggtggaatttattaaatacatgaccagcccggaggtggcggcccgtattatcgagaaaggcatcggtatggctccaagcacggctgtggattatgacgcgctggcggattctgtggaagcgcccgaggcaaagcttctggtagaagcctgcagactgtgtcagaatgcagattaccaggcactgggactgggaaataacttcggggatgcggaaggcgaaatccaggccaaatatgccggccttaaggatggaagcaagaccgtggaaagtgctgtggaggaactggacgcgttcctggaagcggcggaataaggcggtctgccggaagaaaagaacatatggatgatagaggctgtcttgcggatggcctcttcccatatgcggtcttccggataacagtggggagaagaggatgtatatgaaaaaaataaggaaagtgatgacaagaaaaaatgggtttatcctggcatttctgctgcccggaattctgctgttcggtattatttatgcctatccgcttgtgaatatttttatgacctctttctgcaaatggaattacaagaatttccttaagccggaatttcttggctggggccatctgtttgataactatatcaaattatttaccgcagacaggaatttccagatggctctggtgaattcgctgaaatgggttgcccttaccatgctggtacagatcccgtttacgctgctcgtagctttaatattggctaaaaagccactgggctggaagtttacgaggaatgccttcatcattcctaacatcatttccacggcggccataggcctgatatttttgaatctttacagtccctccaggggaatcgtgacggaaatctgcaattggatacgaccgggaagtgatatcagtgtgctggcaaatgagacctatgccttttggggagtgaccttttcttttatcctcttcggcggttcctcctgcctgcttctgctgacacagattttcagcatcgataccagcctgctggaggcggcgcgggtggacggggcaagcgcagggcagatagaccggaaaattatcctgcctcttctgcgtcccatgctcggtacggtatccgtgatggcagccaactatggcctgcttctgtataatgaaattgccctgattacaggcggcggaccggataatgcaacctacagcctgagctattatgtctacaagaccgctctgggaagcacgaagctgaattttgccagaggcaatacggccggggtgatccagttcctgctgggactgcttctggtgggtatgatcaacagggccttccgcacggactatgtggattaaggaaaacgtcgggccgctctgtggggcggcgccgtgatcaaaagcagaaaggaacggatatggataaaaaatcacctgaaaagcgcagtgctttgcatattctgacaggagcaggacgctaccttgttatggcttttgtcctgtttatttcggtttatcccatcctctgggtttttctctcctcctttaagaaaaatcccggagggcttgctcttcctacggaatgggtttttgacgggtatattactatttttacaaagcttagtattcagacctattttggaaacagcatttttattacggttatttccaccgttatcagcgtactggtggtggctatgtccgcctatgtgtcggcgcgtatggagtttaagctgaaggggcttgtcacgctgatgtttaccaccacgctttttattccgtccatttccatcagctttcccatctacaggctgcttggggatctggggctgaaggatacgagaggcgggcttattttcatttactccgggcttgggatagcggtaaccttttttatcatccgaagttatttcctcacgatcccgagggaaatggaggaagcggccagaatagacggctgcggctactgtgcctcctttttccggatcatagtgccgatcgcgaagccgggcctttccacggcggccatcatggtatttctgaataactggaatgaattttattttgcctcgattttactgaaaagcaagggaaaaatgacgataccggcactgctggggcagttcaccacggcctattccaagaatctgaacggcatgttttcggcaattattgtctccgtggtgcctacgatcctgattttctgccttttgtccgaaacctttgtcaaatcactgacggcaggagccgttaagggctgagcgccgtacaggcggcgggggagacggtgccgccgtgcggcatatacaggaaatggcccggacggcaattgcctccttctgttgtgccggcacagtaagaggcgtgacttcccgcttccggcagggtataatacctttataagaaaaaggcggataaaaatgtgggggaactatggccggtaaaaagaaaaaacggtattccatgcgcggaaaaatgataacggtaaatatggggatcatgctgggggcgctgcttttgtgcgggagcatctttgtattctccgtgttttttattatcagcgactatatacaccatgacatggattttttcctgaccgccacggctgatggcatggaatccggcctttcctatctggagaaggtgatttatgcgctccgggattcggaaaccgtgatgggatatatggaagagagcaggaatcgcaggcttacggaggaagagtgcaggacgctggaagccgctttttcccgtgcagtggatatcagcagcccggaaaatctggggaacgtacagatgccggcagcgcttgaaatcagtctggccgattcccggggagattttgtgagcaccggctattatgcgatgccgacctcggaaaaggaaacgggcgcccgtgttttccgggaagtattccgggcctttgaaaaagaatccgcggaaagcggcgccggatatttttatcaggagaaggaagacggccttttcctggcttttcccctttatgacggacttatggacagggcgggcaccgtccttttcaagctgaataaggaggccctggaaaaaaggatggaagagctgacggcaaactatcctggagccttctgggtgctttgtgacagagcgggaaaatcccttaacggagggaatcaggaagccttctggaatacggcgggagctgagcgggaaacctttgaggagtaccggtacgaacccttccgtatggaaacaggcgggcgggactatcgggcttacaggaagcttctgcccatggatttgcaggtgtttctgggaatcccggaaaaccatgccatgatgctgatgtattcctccgtccgtatttatgtgcttctcattgcggtcattaccggctgcggctgcctgttcctgctggttctgatttaccgcctgaccaggcctatcgaggaaattacggataagctgcaggccgtgaaggaagggaactttgagacaaagcttccggcgtatgacagccgggagttcaatgaaatcagcgaagtgtttaatgagatgacggcctatgtaaacaatctcatcaaagaggtttatgagaagcagatatccattaaggagatggaactgaaattcctgcagacgcagatgaatccccattttatgttcaatgtcctcaataccttatccctgcaggcaaaaatggatggcaatgaagagctgttccgcatgatatccaccttcagccagctgatccaggctaaaatatacagaagcggggaagaaaaggtgacgctggggcaggagctttcctatgtggaatattatctgtatctgcaaagctaccgcttcggagaacggttatcctatgaaattgcggtttccgaggaaagactgaaggagcagtatattcccaagctttgtatccagcttattgtggaaaatgcggtggtgcacggactggagccgaaggtggacaatggctttgtgaaggtgagcgtttaccggcaggagggctgcatctgcatcgataccgtggatgacggcgttggtttcggtgcggacggggaggtgacgctgcctcttgaaaaaagggagaaggacagcgcccataaccacgtgggccttggcaacgtacaccatatgattcagctcatgtatggagaggcctacggcgtaaccgtcttttcttctcccggcaggggctccacggtgcggatccgcataccggaggatcagggggaaccggagaagccggaagaggaacggcagaaaaaggaaagcggataaaaaccagaaagggagaacgccatgtacagggtaatgctggcagatgacgaaccgatagtgagaaaggctctgcagacgctgattgactggaagcgtctgggctgcgaagtggtttttgtggcatccaacggaagggaagtcctggaacatatggaagaggaagcgccggatattcttgtcacggatatccgcatgcccggcgcggacgggattgcgcttgttaagtatgtgaaggagcatgagctgccggtacaggtaatcatactgactgcatatgccgatttttcttatgcccaggcagccgtaaaatacggcgcggcggattatgtgaccaaaacaggagcgctggacggcctggaatcggctgtctccaagtgctgcagccagctggaaaaagagcggagggcggaagggggatacggcagggaagaggcggtggaaaactttctgcgcgccgtgctggacggaagcctttatgacgaggaggagctggaacagaggtaccgggcgctgcccctgcggcttgaaaattatctggtgcttttattccgtttccgtctcagcccggaaacggacagcagcacgcggagccggatatataaaagcctgagcgactttttgaccatggcctttgaggaacatatggaaaaaatgcttttcatacagagggatatgctgtgtgtgcttcttaaagggatggaagaaggatatgaagcggcggtgagggccaaatgcgggcagatcattgagatgatggataattttatgcagctttttgtatgtgtgggagtcagcggcatgggaagaggggcaggagatttgaagcgcctttatgaacaggcggcttccgctctggcttaccggtttccggatggtaccgggaaactgaatttttacagggaaggaacggaaccggaggaaatacgcctgccgggggaagaaaagtggctagaggatatctgcggcgctgtggaaaagggggatgccgaaaaagccgtttctctgtttcacgggctgctccggcgacagaaggaatacggctgtaccgcttccgctgtcaggagttccgggatgtcccttcaggaacggtgccggaagttgctgacggagggggagacggatgaacgcagcagacagggccggcccggagggatcgcccatcagatctatggctgtgtctatttggaggaatacagcctgctgatggaaagcctgctgaagaataccgcacaggccatgaagggcgccgcccaggggaaggaatcccttatcagcgcctgtctgcgctgtatcgacgatcattaccgggaaagtctgtccgtgtcggatatcgcgggcagaatcggcgtgaatgccagctacctgagccggatattccgggaagagacaggcaataccataatccatacaatcaatgaaaaaaaactcagcagggccagggaatatctggttcagacagatatgaaaatatatgaaatcgcggaaatactgggatttgagaacgtgacctatttttcccactttttcaaaaaaaacaccggtttgtcaccaaaggattataaggataaagcggagcataatcagaaatagaaaagaagcgtcgtccgggcatttttcccgaatgacgcttcttttcattccttccatatatctctcacaaaccctacataggctgcaacgaagtaaagcagatatatccccgtaaataaaacaagagaagggccgaaataatggaaaaaggtaccgtttaaacctgttatatccagaaactttccgctcacgatccaggcgatcgttccgcttatcagtacagcggggataaccggacagaggtaaaagaagaacatctggcgcagaaccgtcatgtttatctgcctcctgcgcagtccgagagaggaaaggaggcggcagtggaaacagtatttaccggaatcactcagctgttggacggataaaatggtgagagccgcacacagatagaccaggccgatatagataaggggaagagacatcatagtatatccccatcgtccttcttccagcagtgtctcggagaaaagaatatcggaaatgacaagggacatggaatctgtgccgctggcatttattccgctgtattctgtgtgggcattccagagggcattctccagtccgtcaggaagttgtccgggaatcatggaggaaaggccggtataataagtttccatggcttccgctgtctcatcagccacgactaacagatagtctgaaccattatgcccgtcctggcagaaggcgtccgtgtagattctttccagatgcagttcctttccttttacaggaacggtaacatcacggattccatcccccagttccctcacaagccggttctttgtctgcagcagatagccatccccggaaagaacggcctcttcaaagcccagcatgcgccgcagcacattgtaatcgctcagcttcataaaagtatcttccgcatggtattggccccacatattggcaggcatgggaatgagaccgggagtgccggtattgtcctccttttctgtgccggcatttgtaaatactttcagatgagcatagtaatagtcttttaccgaagtgctgccattgtggtagattttatataccagggtatccgcatcaggagagtaacggcggataccttcctcttcttccttcaggctgtcacctgcatttccgactatgttgacggaaaaaggatatttataattaatttcggtattctgataccggttgagcatcagtgcgaagctgcagccgagcagggccagggtgaagagtacggtcagtgtgccgaaggtgaaacgcatcgtacgtattttggaggagagctggcggatgaggaacagattggtacccttatacatacgtttgccccgtttccttaagtagaggctgaacagagaggcaagaccccagtacatcagataaatggaaaggatcaggaggagcatcataaatacaatatctccgccttccaaagagcggctgaaaaaagtgagaacaagtatgatggagaggatacctgcaaagcctgccagaaagacagtagttccgattatcaggtttccttcccgtatttgttcattttcccgatcggcctgcagaagtccggatatgttcattccccggaattttttatgatggaaggccagagacaggagataacagccaaaaaagcaaaggacagtcatcaggaatgcggccgggttaaaacagaaattcagttgataacttttgcctataagagcataaaaacaggcaaacaggaattgacggaaaaagatgccgcatccggtaccgagcaaaaatgcggcgatacccagaaccaggctttctccccagaaaattttcgagatctgcctccgtttcattcccaaaagaagatatgtggcaaactcccggcttcgtttgctcatcataaaacggaccatatattgaagcagccaggtcaggaccaggaggataaagaaggttgctatgccgagcattacggccattatagcggaatcatcctgaagcctgcggatatctgggtcgaacagaagcccgttgaaggaaaacatgatcgctgcaatcagaagcagagtgacaaaaaatacaagataatcccgccatgtacgctttgcgttgcggagactcagtttaatcagcatgattaagttcacctcctgtcaatgcgagaacatccaggatctcattcagaaattgccttcggtcctgtccgcttcgcaccagctcgtgaaagatctgcccatcttttaaaaagaggattcttttgcaccagctggcggagaaagcatcgtgagtgaccatgaggatagtggaacacatggtggtattcagctgatgaaaagtttccatgagcatcagggaggatttggaatccagggcgccggtgggttcgtcagcaagaatcagttttggtccggttaccagtgcgcgggcacaggcacagcgctgtttttgaccgccggatacctgataggggaatttatcctgaatggccgctatatcaagtatatccataacctcccgcgctttttcttccgatttttttccctgttttccctgaagggaaagcgcaaggacaatattttcccggattgtgagagtatccagcagattgaaatcctggaaaacgaaacccagattatcccgtctgaaatcggagagctgatcctcattcatcaaggtaatgtcatcattttcataaaaaatatgtccgctggtaacggtatctattgtagaaagaatatttaaaagcgttgtcttgccggaaccggaggctcccataattccaagaaattctccctgttccacatgaaaactgacccgatccacagcttttgttacattggttcccgtgccataatacttttccacatcacatatacggataaaatccttcatacgattcctgcctttcttatcctgttggtcctgaaagggccgctgttataagttgttgtgcgccggctttaagtatagtataaagggtcttcctgccgtgaggtatcacatcagctttcctcagccttacagttttgaaagatttgccgcccggaatcggggccgttaaaacggggaaggttttcttcccggggaatttccagcaggatttccgtaaaaacaccttcacaggaatgggcacggatagaaagtcccagcttctgacatagctttttgctgaggtacagccccataccggtggaactttttgttttacgtccattggatccggtaaatcctttttcaaagatcctgcttaattcattatcaggaatacctgtgccctcatcccgaacagtaagaagcacctgcattgggcgctcctttgcggtgattgtaattttaccgcagtctccctttttgtactgggcgctgttgcgcagaagctggctcagtataaaaacaagccagataccatcgcagtaaaccgtacaggacacagggatatgcagttccaccttcatatggcaggcggtcagcaggcgccggcagcgggtgacggactcttttacgatgtcgttcaggctgcagggggtaatgagaaaatcacggtagacttcatcggagcgggcataatataaggcttgttccacagcattttctatggcttccgtttcctgcagaagctttcttgcaaaatgcccttcctcttcctgagcggataactgattggcgcacatcaggtttatggaggtaagaggagccttgacctcatgaatccagctttcaatatattccctgtattcctgtttctctttttccagtgtatgtatgttttctatgacagagcggtttgatacacggatgacctgacggtataacctatccgtcagacaaggtgatttttccatgatttctccgataagatacggcttatccaactgatccagctgcagcagaagatggtcgaagaatgttttcttatgacagtaatcgatacctccgtacaggagagtcagcccggccgccagcgaaagaaaaaggagcgcataagccgcagggtatccggtaatccgcagaaaacagaaaagaaaaagaataaagaaagcgaaaaagcaaagaaaacgtattttatctcttatatagtccagcagattcatatttgataccccaatccccgtcttgtcccgataaagtccggtgcgccgatggattccagcttactccggagccgggtcatgtttacgctcagtgcattgtcgtcaataaaaatttcctcatcccagagataatcgaccagctcctcgcgtgatacgatttttcccgcatgcttcataagataatacaggattttcagttcatttctggataactcggcaggatggctttttccctccggcagggatatggttccggaagccagatcgagctttaaatttttccagtgaagggctgcatcctcttcccgtttcgtcctgcgcagcacagcggatatacgggccagcagaattgccggctgatagggtttggacaaaaaatcgtctccgccccgcagcagacagttcagttcatccatggaggtatttcggcctgtgacaaatataatcgggactgcggactccttcctcagaagggagcagagcgtgagcccgtctattcccggaaggccaagatccagcaggatcagatccgggcgggcttcccgtataagcgtgagcagatccccttccggttttggcgcggatacccggtaagggacactttccagaagaagcatcagttcttcccttatattcgtttcatcttcgataatcataatgtgctgcatggcatcagcctcttttccagggaaatttggtattttaacaggcccggccggataggattccgggcagggcctgtaattgtccgtacattcagattaccataaaagaaggaaacaggatagtgcttaccgcatgatccttccgtcggaaagcagaacgatccggcgcccctcctccgaagaagggcaggatatctcataagtatgggaagtggtttccagcgtataatccagaggaagcagactgcggttctcttcgcagggagagtattcccggaggatatcccgcagggtgtccaggctgccgcaccaggaaccatgcaggtcatgatagatattctgcgcataatagagcttgcgcagctcccacttacgctgctcatcttccggtatgcggcatacgccgtcctcccctccgtcctctgtaaagaagacaaagccccacagctccggataatggatattgataaccccggtaggggaccagacccagttatcctccggcagaggatttccgtccggagcggttagcttccggtaacagccgtcttccttctccactttccactggaccctggaaaaattaatcctgtaatattctccggccccgggcgcccgtttctcaggcaggcattccgtaatggcggcgaaagggatggccacctccacggaccagcttttattctccgggccgggcgaattaatacttccgcagacagaaaccgccgtccggagtccgtgaatatcataaccgttcagggcattccctccgtcccggtaagcggagggcaggaagagatcccataccgtattcagaacattcatttcaaattcataatactgccgggtatccgagtccggatcaataaaaatttcaaaatcattatcccggaaaatcacatcgtcccgttcggtaacgtttccccagatctcatccccctccagctgcgcacctatgtacaggttttcgtcatcccacagcaattttgcccgggtaacaaaccgtgggaggggcatatgttttccttcgatatccgcaaaatcacaggtgaattccgctttttcccagaaaggcttatccagccgcccgtcggggataaaggggagcccggcgcgtctgcacagataaacagggggatgaaaaccaacggaaggaatcggaatgcgtatagcgtccatagtttacctctttctgcacgtaataataggaatgtaaaaaacttgtgaacgtgcgtcacagaaaatattttattaaaacagttttctgattataacatgcaaagcatacggttgcaatataaggtaacaaaatgaacattatccgtataattaacatggcaaaagtgaacgaaaaaatacactaaaaagaaaagattgtttgttgaaaagggaaaaaatggaaaagcattatgagaaatgttgacatataagttgaatatatgtattattttattgacaaaagcacccgaaatgttcaggaattaaaagagcatttgttcacaatgtacaagcgtaatttgaggagaaaatgttcactaatgttcactattgccttggtgaaatatgctgccggatgtatgaaatgcagcagtataaaatatattgcgcagggccgcaaaagtaatttcagaagggagaaagtatgaaaacgagaaaggtgagaaagaaaggatccacaataagggcgctgaggagggacatatctctctggctgttctgtgtcccgggtgttgtattgacatttatattcagttacatacctatgtatggtgtccagctggcattccggcgatacaatgccaaggcgggtatatggggaagcccctgggtggggctgtattattttaaacggttctttgaatccccgtattttgcatccacgatcaaaaatacactgatactgagtctgtacggactggtcgtatcctttcctattccgattatcctggcccttctgctgaattccttccggcataagagatatcggaaggtcatccagaccgttacttatgcgccgaactttatatccacggtggttatgtgcggtatgattattctttttctttcaccctctgttggtgttattaacaacgtagtgcggtttttcggaggagatcctgttaatttcatggctaaaaaagaatactggcgccacatttatgtttggaccggtgtctggcagggaatgggatggaattccgttatttatttcgcggcgctttccggaatcagcccggagctgcatgaggcggccaagtgtgacggagccaccaaattccagatcatccgccacatcgatcttccttccatccttcccacggcaacaatcctgctgattatgaactgcggaagtattctctccatcggttttgaaaaggcatatctgcttcagaacgacctgaatctgagcgtttcggagattatttccacatatgtttataaggtgggtcttatcaataacgatatgtcctattccaccgcgattggccttttcaatacattggtaaacctggtgatgctgctgattgtaaataaaaccgcggacaagctttccggcaacagcctgtggtaggaggatgacgatgaatcagaaaataaagaaagacaataaagggaaaacaatgaaacgctgcagggaggatatgatttttgacacgatagtatttatcctcctgacggtaatcctgatagtggtggcgtatcctctgtattgggtaatcatttcctccatcagcgatccctccgccgtatcgggcggcagggtgctctggaagccggtcggttttacgatgaagggctatatggaggtatttaaaaacagtgccgttatgaagggtttcctgaattccattatttatacggtgtgcggggtatgcattaatctcttcgttacgctgccgacggcctacgccctttccagggatcggttcgggggaaagaaaatagtgacgttattttatatggtcaccatgtttttcggaggcgggctgattcccacctatctggtaatccgtaacctgcacatgctcaataccatgtgggcgctggtgcttccggggtgtctgagcgtatataacatgatagtcgcaagaaccttttttaaatccaatatatcggaagaattatatgaggcagccgagattgacgggtgtacccagggacagtttttcttccggatagcgctgcctctgtctgcggcgattacggctatcctggtgctgtattacggcgtaggccactggaattcctacttcagcgcgttggtttatattaccgatgctgagaaataccctctgcaattggttctgcgtaatatcctgattaccaacgaaacagcgctggcccagtcggccaccaccgaggcggccagggcggcgctcagggaaaaacaggaactgatagatgttatgaagtattcgctgattatcatcagcagtattcctgtcctgcttctttatccgtttatccagaagcattttgtaaagggcgtcatgatcggttccctgaagggctgaggaaaaaagattatttaccggcagtgtgccggataaatatagaaaaaaacaggaggtaaaagaatgaaaaagagaatagttgcactgctgctcactgcggcgatgtgtgcgggtctgctggcaggctgcggcaaaagcagcgataccgcggcgacagggggagatgctccggaggaaggaagcgtatcgtctgcccggacggatgacagcggaaaagtggacggagtaatgtataaggaggggctgccccttgtagatgagggaacctacagcttttccatattctgtgatggatctaatgaaaccgatgaattctatatgctcgatgagtttaaaaagcagacaaatgtagatgtggaattgcgtatgttccccaatgaaacagctacggaaaggctgaacctggatctgaactccggagactatgcggatgtggtcggcggctggatattgaatgacagcatgattcttacctatggaataaaccagggcgtatttattccccttgaggattattttgctgagtactgtcccaaaatcacggagatactggatcttccgggggtgagggaggaaatgacggccccggacggccatatttatacgattccctatgtatgtgacgacacaactgtcggctattctccgtacatcaacagtgactggctggaaaacgtaggtatggaaatacccacaaccacagaggaatttgaggcggtgcttaaggcgtttaaggagcaggatgccaatggaaacggggatcccaatgatgaaattccgttttctgcagatccgaacaacaagcatatcgaagcgatggctggatggttcggccttcccatggataagaacggcataggaatcaaggactccggcgaggtggtatacgccgggatcagcagcacctacagggagcttttaagctggcttaacagcatgtatgagcaggggcttatcgacatggaaattttcacccaggacaaagctacctgggaaggaaagggaaacaaggatttgtacggcgtatccatcgcttatgggagcaacgaattttccggaaatgtgaaaacctccgagaaggatgaatatgatgtcctcccggttctcaataccgggaacggaggcagatggctgcgtgatacaaacggcttcagcgtatacaggacgcaggctgtggttacggataacgcgaagaaccccgagataatctgccggtggtttgacaatgcctttgaactggagaacggtatcggctgcaacagagggcctgtaggtaaggtggtatttaaagaggatgacggctatcacgcaatcgataccaagacccttcccgaggatgaacaggaaaaactaagttgggggaatctatggccgcagtcactgcctaaatatgtgccctccggatttaagtatatcgaagaaagccccctgtatgacgagaagaaggtaatggaaaatacctatgaaccctatctgacaaaagaaatcgttccttccttctggataccgcttgacaagattgaccgctattccgacatagccaccgcaatcagggattatttcaaccagcagcaggccatgtttgtatccggtgagctggatattaatgacgatgcccagtggaagaactatgtggacggactctatgcactcggcctggaggactggctggaggttcgcggaattgacaaaatagaggaataaggacggaaaagcaagctgaacggcagtcagggagaaaaggcatattaccgtaaaaaagtaatatgtcctttttcattcatcccgcggcggcttcaggtatgcgtcggcccacagggcttaaccgcctgcggggtgcagagaaaaataagaaatccggaggaaatcagattatgatgcaggaatggttcagaaaggccaaactgggtatttttatccattacggaatttatgcggtgggagatgtgtccgaatcctggtcctttcataacgggaatatctcttatgaggattacatgaagcaatgcgacggcttcaccgcctcaaaatatgatcctgccgcatgggcggagctgtttaaaaaagcgggcgcgcagtatgtggtcatgaccgccaagcaccatgacggggtggcactttttgatacacagtacagtgacctgagtgtggtaaagaaaacaccggcgggtagggatctgatcagggaatatatggacgccatgagtgaggcgggcctgaaaacaggcatctatttttcactgattgactggtcggatccccggtaccggagcatttatcctgaggggatgaaaagagaagactgcctgaaggatatttacggttctccggcgggcggggaagaggattatgaggcctgggaagagttcctgcagtttaacagacaccagcttgcggaactgatgaccggttataaaaccgtggatctcctctggtttgacggtgactgggaacgcagcgccgcgcagtggaagatgccggagtttcgggagtatctccattccctgaatcccaacgtagttttaaattccaggatgcagggatatggggactatgaaacgcctgagcagggcattcccatttatgggcctgagggagaatgggaattctgtactaccataaatgactcctgggggtaccggcccagcgataatgactataaaacgagcgggcagatcatacgaatgttctgcgactgtatcacgctgggaggcagactcctgctggatgtggggccaaaagaggatggtacgctggatgagcgccaggagaaagtgctgcttgatctgggcaactggattcatgatcatgaagaagcggtatacggaacgggaaagggcctgagctatcatcagtttctgggcggaagcaccatttccgaggatcaggagactctgtatctgattgtatatgacaagccccttgaagcagtgtgcgtaaagggactgaaaacacctgtaaagagggtgacggttctgcatagtttagaagagctggactttacctataccggcgccctgccctggagcggtatacccggcaccctgtggatttgggcgcagaatatgcagctgcatccttatgcaaccgtactgaaggtagagctggaaggaaaaataacctataatctgggacatggagaggcggtaacgaacaatgactgaaaaagaaattacggaagaagtggttgaagagggtgtacataattacagcgccgcggatgcctatgtatggccggcggatccgaaggtccggcagaagctggagtggttccaggatcagaagctggcgctgatgatgcactgggggccatattcccagctgggtattgtggagtcctgggccctgtcggacgccgatgcggaatggtcgagaaagggaattgactgggaagcgagcggaaaagaatttaaggaacagtacttcgggctgaacagaaccttcaatcccatccggtttgatcctgaaagatgggcggatttggcggaggaagcaggcatacgctatctgctttttacgaccaagcaccatgacggcttctgtatgtgggacagcaggtattcggactacagaatcacggcggaggactgcccgttccatacccataagtatgcggatatctgcgggcatttatttgaagccttccgtaaaagaggaatcgggatcggagcctatttttccaaggccgactggcatgtggacagctattggaaaaagggctgcgcgagggacgactatatgtggcggggcccctcttacgaccctgcggcgcgtcctgaggaatgggaacgttttgtgacgtttacacagaatcagatcaaagagctggcagccaggtacggaaaactggatatcatgtggtttgacgcggggtgggtatgccctcagtccggccaggatatacgcctgggcgaagtgatagatgaaatacgtaactggcagccgggaatgctctgcgcggacaggacggtgggcgggccttacgagaattatattacgccggagcagtgtgtgcccgaccagccgctgggggtgccgtgggagagctgcatcacgctgggaacctctttttccttcgcctatgaggatacgtataaaaagccaagagaagtgatcctgctgttaatcgatattgtggcaaagggcggtaacctcgccattaacgtggggccgcagcctgacggcaggctgcctgcgggagcggtggaatccctgaaggggatgggcagatggctgaagctttacggagatgccatttacggcacgagggtgtgcgctccctataagaaaggaaatatcgcttttacccaaaaggacgggaaggtttatgcgctggagctgttcccggaggaaggttctccggttccggaggaggtttttcttccctgggaaggggaagtgaagaaggtgagtcttctggactgcgggaaagaggtgccttttaccgcagggaaaggaggcattcttgtaaaaatgcttccctttgaggaagagacggcgccgatagcaagagtatacgtactgcataggtaagagggagaaacgtcaatgaataaagtaatcggatatgtgggaacccgggatttgggaggaatgaggaatgcggacatccgctgtctggatgtcattaatatcgcgttcgggcaggtggaggattcccggatggtatgggatggaagcggagcaaaggaagcactggccaaaatccgcggggtaaatcccggaataaaaatattgctttccgtaggcggctggggagccgacggattttcccagggttcccggactgcacagaacagggaaaaaatggcgcagagcgcggcagagctggtaaaggaatacggactggacggcattgatattgactgggaatatccgtgcagctccctggcgggaattgcttcggatccgggggataaagaaaattttacgctgctgctgaaggctgtcagggaacgtctggacgctgccggagacgggtatatgcttaccatcgcggccggaggggacgcctattttacggcccagacggacatgaaggaagcggtgcggtatctggattatgtgcagctcatggcctatgacctgcagggcgggttccagaaagcgacagggcatcatgcggccctctatttcggcagcaggaacatgtcggatgcctgtgcggacaaagcggtgaggctgttcatggaagcgggggtgcctgcggaaaaaatagtgcttggcattcctttttactccagaaaatgggaggatgtgaagggcggcggcacaggactgggacaggaagcgctcacggtgggaggctatggcccggactacggagaactggaggcttcttatatcggtaaaaacggcttccgccgctattgggatgaagaagcgaaggctccctatctgtttgacggcaaaacattcatcagctatgaagatccgatgtccataacagaaaaagtggcctactgcagagaaaagggattgtacgggatcatgtattgggaatataaatgtgactctgccggtgtgctgacatgcttcattcgggaaaaaatggacggacaggcggaagaaaggcggaaataggaaatggtttcagcgcgttttcaggattatgcccggaagaaatatgcggaaagagaagtttttctcgcgccccttcgggaggagctggagaatggcttttccggctgtaccggcgatgaggcggtctgtatgaaattcctctatggcaccatgccgctgcgggacgccggggaatatgcattttccacatttctcgggtttgtgcggcatgcgctgtggcttcgggaaaatgtggaatggtgcaaaagcctgccggaggacattttcgccgattatgtcctttcctatcggataaataatgaagatatcactgactgcagagcctttttttattctcagatcagggatcggattgacggtctggagccggaggaggcggtaaaggaaattaattactggtgtgcggaaaatgcggcatatgaggcctctgatgaaaggacggcttctcccatgacggtctaccgctgcggaaaaggacgctgcggggaggaatcggtatttgcggttacggcataccgcagcgcaggcataccggcaaggcagatctatacgcccagatggtcccattgtgatgacaatcatgcctgggtggaggtatatatccgcggttcatggtatttccttggcgcatgtgagcccgaggaggtgctcaataaaggatggtttgcagcaccggccagccgtgccatactgattcacagccgtgccttcagtgatttcagcgcagatggacagcaggagagcctggggagggacggggcggcggtgtattataacaatacgccggcttacgccagaacctgccgtcttggcatcaccgttgaggatgaacagggccggccctgtgaaaaagcgggtgtggcggtggaaatcctgaatatggcggaatattatcccgccgccgtgctcaccgcggacgggcagggaagagcggaaatcacagtcggtatgggaaccgtcagagtaagagcgtggaaggatgaccggtttgccgaagcgctggcggttctgccggaggaaaaggaaataaggctggtgccggaattctcggctgaagaaaaagagtgggcggcggatatatgggagcaggaagaatggacgccccctcaggagtatcccatgcatcccggaaggcagtctgaggaacagaagcagagaagggaacggcggttcgccgaagccggagcaaaaagagagagccgtttttcggcttattatgaggaagaaaaggccgcggaatatccgcaggaggcttttatgctgcgggctgcgggagaaaacttcggggaactatatgaatttctggtccgggacggttcggcggacagaaggcgtatgctgcattctctttcggcgaaggattacaaggatctgaagaaagaggttctggaggatcatctgctttgtgaaagaggggactggcctgaggatatttatgtaaaatatctcctctgtccgagaatcggcagggaggaactcacggcatggcgcagttttatcagaacctattttacagaggaagaaaaaagggaattccgtcgggatcctgaacggatataccgacacatacgggaaaatatccgttatgcgccggaacaggagtatgcggcgctttgtgcgactccggcagggtgcctgaagctgaaatacggcagtcctgagtcacagaacatcctgtttgcagccatatgccgcagcctggggattccggcaaggctgaaccatgttaccgggaaaccggagtattggagaggggattcgttcagaatacctgaggaagccggggatgaaaacacgaagggcagagcggcgcttgtgcttttggcggaggacggagacagctggaattatttccgcagctggaccctgggcaggctggaaggaacaggctttcgtaccctggattattccggctgcatgccggaaaataattcgatgtacctggcactggaaaaaggtatttacagactgatcactgtccgccgaaggcctgacggaagccagtgtgttctcaggaggacgttcgcactggaggcgggagagacgaaacggattaggctgaaatgcccggaagaaaagaacggggatcggaacgagaaaattccgctgcaggattttgctttaagggatgcggacgggaacgcacacatgctttccgcgctgacgaaggaggaagcggcagtactggcctttctggggacgggagaagaaccgacggagcatgtgctcaatgaactgctggactgcgcatcccgctggaacgaaagagggcacaggctgtttgcggttctgcgcagcccggaagaactggaaaacagaacacttcggaaagtactggacaacgtatcaggcattcaagtatatgctgccggccgggaagatatggaaagaacggcggaaagcatgggtgtggacagcgagaagcttccggtgctggtcattgtggggaatggaccggccggaatttatgcctgtgccggctatcacgtgggaagtgtggaactcatgctcgggatagccgggcagtatgagaaataaaggagccggaaatgatatccgtagtaaaaaagaaaaatgaaatatattctgtagattttgtatgggaaaaggatgcccatatccgcagcttcaaaatggggcttgagaaggttttccgcggagaatacctggaaagcttgctggtgcctctcagcagccaggccgtattgctggcaggctgcggtaaagaggaagaattggggcttcttcaggttaaggagatttcggccgcggtttccaaacggtgcaaggaactgcatatcagggaaatttccctggatcccggatgctttgtggaaaaactgggagaaaaggcaattatagccgtggtattagggctgggacttggcggctattcttacgaatacagtaagacggagaaacaggagtctgcggactgtaatttccagctggaaaatatggagggcttcgaagacagtcttcaggaagggctggaactcttaaaaggcatctgttttgccagggacatggtgaatacaccgggcaatcatctgcggcccatggattttgcccggaagatcacggactatgtcagtgactgcggtgtggaaacggaaatgcttgtatatgggcagctgagagcccttcatatggaggctctttatggtgtgggaggcagcagcgaatatccgccctgcctgctgattctgcggtataagggagatcccgggagcaaggaaatttatgggctgatcgggaaaggaatcacctgtgatacgggaggctattgtttaaaggaaggatcctccatggcgggaatcaaaggggatatggcgggagccgccgcagtgacggccgcggttcatgcagccgcggccaggaagcttaaggtgaatattacggcctgccttccgctgagtgaaaaccggatatcccagtctgcgcttcttcccggagatgtcataacaggttattccggcaagacaatagaggtgctcaatacggatgcggaggggcggcttgtgctgtcggatgcggtcagctacgggatccgtaaggaaggcattaccaaagtgctggatattgccaccctgacaggcgcagtggggcagatgctgggaaataccatcggcggaaccatgtcggatgacgattctttttatcagctgttcgaacgtgccctgtcctggtcggcggagcgttatctgcggcttccctatggcaaagaacacgaaaagatgatcgacagcgatgtggcggatgtaaaaaatgtgggaggaggatgctgcggaacgattacggcaggactgttcatccacagattctgtgaggggaaaccctggattcacatggatattgcaggaacggcgtggtgcgggacacccacctatgcgtttgaaagcaagggggcaaccggcgcaggcgtgacaacgctgtactatctgatgaaagaggcgcaggcagactgaagtacagaggtgctccgcggtctggcggcagaaatgtatagaaagtttcataacagaaaaatacataaggatgcgtatataggaaatgccgggctgaatgcccggcatttcctgtgtcacgcttttttcgcactgcctgttgaagaacggaaaatggtctgggtggaaatataaataatttcagaacgtgtgtctgggtgttcaatacggtataaaatctgcagggcgagacgcagcccgatatcctgattgaatacctgcacggtagtcagttcctccgccagagggctttccatatttccgtcaaacccggatacggcaacgtcttccggtattttcagtccgcgctttaacagaagctgcatcagaaggcaggccacatagtcgctgacacagacaaaggcatccggcatgctgggaagcgtattaagaaaagcatcgatttcctccttatacgtatcggttccgatggaaccggtaagagaaagctccggagacggtgaaaggccataacgctccagcgttttggaaaaaccctcataccgttcgtaattggactgcgcataattgatatcgccgatgaatccgatttttttacgtccctgcttcagcagatgttccgtgatttccgaaatgctgatgctgctttccattaaaataagatcgccattcagagacgagggagggatggaggtggcggtatccagaaaaaccttggggacaggagcctctgacaaaaggcggattaactgattattatatacattcaggacaataattccatgagtatttccgtttacaagggaagccggcagagtataatcctcatcgatggaagaaggaagataagtataaaccagattgacattgtggaatgaaagctcctttgcgatctggtggataatgttcatccagaaaatggaggattccggccggcagacagcaaccgcaatattgaccggaggcgcagcagtcttttgggaagggagaagaggagcgcattccggaaattcgtatcccatttcctgcgccgttgtcagaattttcctgcgcaggttatcggaaacacctttctgaccgctgaataccttccagacagtggttcgtgaaatgccgagggaactggcaatatcctgcagtgtgacctttttcattatcataccaatctgcgcgctgcgctgcgcgccataacagggaaaagaacggaagccggacacgcgtaattacggctcccgcaggtgggaaaaaacgagcatacaaaaggcttttcgggcctgttccaattatattattatatcattacaggacatattttttcaatgaaatgtttggtataggggactgttacttttcaaaaatatcctgtcagatccgcctggttccataaaatcctgaagagtgccggctctggcggcttcctttcgcccggaccggttttctcctatacatgcagactgttttgcagtaaaatgaaagtgcaatcagaagtccttcgattcagcaacaaaaaatattctacaatgacagatacagatttaggaagggaaaatggttagaaaggaagaggaaatcatatgaagagaaatacactgttcgtactttgtctgcttgccgccctggtgatggccggctgttcgcggaagaatacggaatcggctgtcccggactctgttacagaagagaatggcggggaaaccggtaatgtatcaaagggaggcgaaacggaggaggtgcccggtgagcttacattccgcggggaaaagctgtccggggaggatgccgttttattttctgagattaaggaagcggcgagggctgaaatcctgctgtttgactgtgccgattatgatggcgacgggaacagggaggcgtttgcctttgcgggtgtgaataatgacggcattctggaagggcagaggtggtttgcgggggctgagggagccgtccctttaaagaacggcggggaagcggcggaatatctgcaggataagagtgccgtagtggaaacgccggaaaataccgccttttggtatacggaatcagacggaagcagcgccacatcttctctgctgtggggagtttcggacaaggttccttatgaaagtgtcctttccggaaaaggagaagcctttacggtgacggaggacggcacctatattctgtaccaaagcagcacggatgcccgcgaggatggaacggggcgtacggtaaagccctgttatttttattatgaaaacggcagctttcatgaatatggggcgatggccgtgggacaggacagattcctgggcctgcccggcgcggcggaatgctttgcgccttacgaagcggagggctattgggtcagggatatacgcattcgtggaaatggtcttgtacagctgaacctgagaaaagaagaccggaatgtaaatgtgacctgtgcatggaaggacggtaagctttcaaaagaagaagaaaacgatggcattgccggacttttggtgggagaactggcttcagcgcagtggcatggacccgaaggagcgctgcagcagctgtgggagaaccggcgtgctgcagaggaagcggatggtacggccatcgatatagaaccggcacaggcagcctggtatgacctggacggagacggagtcccggaagagatccggtacacagtgaggacagaggaagacatgtatggagcggatggtatggaagtcagcatcgatggaaagactgtctgggagacagatcaggcggtttccatcggttatcagctgctggtggttgatcttgacagaaatgacgggaaaaaggagctggcagtatatgggctggaagacagcggaggcttttccatgctgaaattttttgccgcggaggacggaaagcttaaggaactgggagatctgagagaggtttcgattctgggcgggctggggaatctgtaccggattggggtattcgattttgacagcggcagaatgatgcggcttcccggtgacagcagcatagagatctgggcggatacgcctgtgttcgctgaggggcttggctcttattatgtgaagctggattttgtgtttggaagttcgggaatagcgcagacagagcgacaggaatatgacatgaaggttcccctgacagggggagagccttatctttataccgcacagcagcccatacttttttacagcacccgggaagaatgtctggcgggagaaccctcttttcttgcagttccgggagaacagctgaactgtgcggcgcttacacccgctgcggaaaatcagatatatgtaaaaatgagacggacaggtaccggagaggaaggctggacggttttatccgatactcaggtgtttacggaaacaccgggctggggctgagaatctgtaacaggctgaatcattgttattcctcataattctccatgatcataagaaatcaaagaaaatgagaaacggattccattaccttttctgtaaaaacggggtagaatcagggcatgaaaggaggaataacatgaacaaatataaaatgacagggagcgttctgctggccgccgtccttgtttccagcctgctggcgggatgcgccgctgcctcggggaatacaacaggaatggaaggagaggaagagagtatgtcagtgaatacggaaaataagatgacggatgaagaaaacctgcacaccatatatttggcaggcggctgtttctggggagtagaagcttatatgaagaagcttcccggcgtcaaagatacggaagtgggatatgccaacggagacacggaaaatccgacctatgaggaggtatgctataacaataccggccatgcggaaacggtaaaggtggtttatgatacgcagctcatcaccacacagcagctgctggacggcttcttcaaggtggtggatcccaccagtgttaataaacaggggaatgatcggggaagccagtatcgttccggtatctactatgtggatgaggaagaccgggatatcgcggaaaaggtgctggcagagcaggagaaaaggaatgctgttcctgtagttaccgagcttctgcctttatccaatttctatccggcagaggaataccatcaggattatctggacaagaacccgggcggttactgtcacatcaatctgaacagtgcggacgaatttattaaggaagaaggattgggggcggaggatctgtcgggtctgatcaggccggaagactatacggtgcccgatgatgaggaattaagggaaagccttacggatatccagtatgcggtcacacagctgaatgagacggaacggccttttatgaatgaatatgatgatgaattccgcaaggggatttatgtggatatcgttacgggagaaccgcttttcagttcggaggataagtttgattccggctgcggctggcccagcttttccaaagccattgctcctgaggtggtgaatgaaaaggaggataccagccacaacatgaaccgtacggaggtgcgcagccgagtgggggacagccatttgggccatgttttcaacgacgggcctgcggaatcgggcggcctgcgttattgcatcaacagtgcttccatccgttttatcccttatgaaaatatggaagaggaaggctacggcttcctgctctcaatctttgatgagtaaaaattccttcagggatctgcgtatctggtccgcaggtccctgaaatatgtggctgaaggattaaaacagggggagggatcggtttatgtataatcttctggtggtggatgatgagagtattatccgcagaggaatcagggagcttgtggattttgaaagcctgggtatcggcggatgctttgaggcggaagatggggaaaaggcgcttgcggtcatgaaggagcatccgattgacctgattctggccgatatcaacatgccaggtatgagcggcctggagttctgccggagggcaaaagagcttgatgccggagtgaaaatagccatacttaccgggtatgattacctggactatgcgatccgcgccattaagatcggggtggatgattatgccctgaagccgctttcgaaggacgatatacaaaagctgctctccaggcttgcggaaaagaaacgggaaaccgacagcttcaccgccgtacggcaggcggtggataatctggcgatggaagccggttcggacggaaagggcagccttcgcggccagatttcggaagcattggagaagcatctgtctgataccggtttttcactcagtatgctggcggaggaattgggatacagtgtgagttatttaagcactttgtttaaaaaatatttcggtgggaatttcagggactatcttctggacgtgaggctggaacgagccaaaatccttcttttgtccacggaaatgaaaaactatgaggttgccgcggcggtgggaattgaggatccgaactatttcagtgtgtgtttccggcgtaagtataaaacaaccccaagggagttcagaacggaggcgggacgtggaaaacagatgtaggatccgaaactggttccgcaggttcggcgtgcagatttcttttttctatctgggcctggggctggcgataatactgattctgagcgggaccatttatttctttacagccagtctgctgatgaatgagatggtttccaaaacccatgatcttctggaactgagcggtaataacattgctacctatattgccagagtgaagggggaatcggatgtttttgccaacagcccggtcctgcggcagtatctggaggaaaacgatgagagcctccggcccgtactgatgtcgggcattgaacagctgcttaaaaatgatgactgcaagaaatccatcgtggtggtttccaaggacggacgtatcctttccaatgaggaaaatctggatatgtcggtttcggaagatatgatgaaggaagactggtacatggaatccatccataacacgatgcccgttcttaccggagcgaggatgcagagcttttccccggataaagacaactgggtgatttcggtgagcacggagatcacggacagtgccggtgagaatctgggcgtccttctgatggatatggaatatggggtggttgaagaacatctgcgcagcctggacgtgggcagagagggctatgtctttctggtaaatgacaggggggagctggtgtatcataaggataccggattttttacttctcctgaaaaaaaggagcagctgctgacactgcttgcagagggggatcgttacgataaaaagaaaaaccttctcgtttatcggacggaaatagaaaataccggctggatattggtcggcgtggtgtctctggatactctgaaaatgctggaacagcagcttcttgaggtggtgctttttgtgggagcgctgcttttcggcgcggtgatcctgctggggatcctgtttacccgccgtctggcggttcccatggctgatctggaaaaggggatgggagaaatcgaaaaactggccgaaatcagcgtgcgtaagcatagctttcaggaagcggagattttggctgaaaattataataaaatgattttccgcatccgggggctgatgaaggaaatcgcacagaaagaggaaacgcttcaccaggcgcagctgaatgcccttgtgagccagattaatccgcattttctttacaataccctggataccattgtctggatggcggaatttaacgacagcgcgaaggttatcgccctcaccaagtcccttgcggcttttttccggctgtccctgaatgggggaagggagctggttacggcagccgacgagctggaacatgtacgtcagtatctctatatccagaaggagaggtacggggataagctcagctatgaaatccgggttccggaggagtttctggactataccgtgccaaaaatcatccttcagcccattgtggaaaacagtatttatcatggtatcaagccaatggagggattgggcaggattctggtgacggcgcgggaggaaggagaatatctgatattcatggtggaagataacggagcgggctttgcccccgcatcgctgaaggatggcaggtgtgtccggaaaggaagcgtggggcttaaaaatgtggaggaacgcctgaagctttattatgggcaggactgcggcatatcgattgtttcctctccgggcgcgggctgtacggtgaagcttatgctcaaaaagcatgtggtgcacagggaaacggaatagctatgtgctattgaaaaccggcctgcttcagtacatggccgatgcgggcaagcccttcttcgatcttttcttccggtgtgttggaaaaattaatgcggagggtattgagcctgcatttgttggggaaaaaggaatagcccggtacaaaggctacattttccgcaatacagcgttcaagaagctctgtggtatttatcgcttcattcagttccacccagaggaaaagtccgccttcgggcctggtgaatacggtgtcggaaggaaaataccgggttatggcttcgatggctgtatcgcggcgtctgcggtatacttcccttattttatcgatgtgggcatcaatatcatattgctccagataggcggagattacgatctgtgcgatggtgttgcactgcagatcggctccctgctttaccagcacatatttgcggatcacctccgcatcccctgcaatccagccgatacggtagccggggcagaatattttggagaaggttccggtacatatcacgcttcccgagcggtcgaaggacttgacggagggtaagaagtccccctcataccgcagttctccgtaaggattatcctcgataacggcgacacggtattttgcggacagctcggcagcctgcttccgccgctccaggctccaggttttccctgtgggattttgaaaattgggtatgatatagatcagtttggcggcggggtattccttcagcgctttttccaggcttgcgggtatcattccctcatcgtcggtatcgatttcgacaaaacggcagccataagccttgaacgcacttattgcggccagatacgtggggctttcacacagaaccacgtcgccctcatccaggaacaccttcccggaaagatcaagggcctgctgggaaccgtgggttatcataatgttctcatcgcagaaggaagtgccaagctgtgtattcatgcgttctgcgatccatttgcgcagcggctgccagccttccgttgtggtgtattgaagcgcctgttcaccgcagcggtccaggacatagttattgacggcccttatttcttcgatggggaaaagctcaggggcgggcagaccgccggcaaaggaaataacctccggcttttccgtcagcttcagcagctccctgatttccgacgcttttatttcagacattcttctcgcatatttatattccatgtcgatgctccttataagatagggttgatttcattttcagcgggccatgccgcttcttttgacagacgtaataattccctgatggcttcacataacagcctgattccttcggaaatcctgtttttcgcaggaaaggtataattcagccggacgtgggcttcacccttccgggttacgagataggagggcattcccggcaggatggcaacgcctccagccgccgctctctgggcaagcgcctctgcggaaacgccttccgggagagtgcaccacagataatagcctccggccgggatattccaggacaggccgggaggggcatatctgtccagcgcctccgccatgatatcccttctttccttatattccctgcggagcagggtgagatagtcggccattccgccgctgacgataaaacgctccacgacctgctgggaaatgcagttggaatgcaggtcagcgagctggcggatattgcagagctgatgtatcagttttttgcccgtgcagatccagccgagacgcagtccgggggaaatggttttggagaaggtggaaagatacatgacatatccgtttttgtccatggatttcaggggggagagcggctgtccctcaaagtacagctctccgtaaggatcatcctccaatacaggaattccatatttatttaccagctccaacagccggatacgtttggcaaggctcatgcagatgccggtgggattatggtaggcaggcattgtataaaggaatttgggccggtaccgggacaaaagctgttcaaggatttccatatccatcccgtcattttccatgggaaccgccatgattttggccccggcggcccggaagctctgtatggcgggaaagaaggacggttcctcaatcaggatgagatcgcccggattgataaaggctctggtgatgagatctatcccctgctgggaacccgacagcaccatgatttccgagggctggcagaagcaggaacgcttctgcatataagtgctgatcacctttcgcagagaggaaaaacccgccacaggtgaaaccagcagttccttctgcctggataacagctccgcttctattccttcaaaggcctgggtgggcagattttcaaaagaggcaatacctgccgcaaaagagataacatccttctgattggctatttccagatatttatttacatcgaaaggctcatggtttttcaggtagtcgctgtacaggaattcccagatgggctctttctgataaattgttttgacgggatattcaccggcggtactgacagccacggtaccgcgtcccacatgggaggccatcagtccgtccgccttcagttccttataagcattcagcacggtagtccggtttacgccaagagcgtccgccagctggcgttccgaaggaaactgaaaaccgtgggggatttcgccggatgtgatctgggcctgtatctgctccacgatttgtttgtacatcggtatttttttcgtcttgtcaacctgaattttcatagcagctccgatctgtgcacattatttcgtaatgaaaacaagaagataaaaagtgatcttctgtttttgaattggttcgaaccaatatcagtatgcatgtaaaattattggatttcaacatccaatttggattatatttatacatccaatttattttatggaaatagaggcagaaggaattgaagaaaagcgtatatgacacagaagcgaattcttttgattttataaaaagaaaggatggctgaccacaaccatcctttccctattttttggaagagaagactaataaaaaaacatcatcacgtatccgcacctgtttcataaaacggcttaacagcaccgaacagtgcggcatcattagcgagccgggcaggaacgatttctgccagctgccgatactggggaggaagctgtcggtttgtctgtttttccaggagcggaatcaggatgtcactttgctttgatatgccgcctccgattaccaccctgtcaggatccagcatcaggatattgttagccaggacgcgccccagcttcgcggtccagtcctccagaagctgcaggcagcagggatcattgtcccggatacgttggataaaggcaaagccgtcaagctgggagccggtgagcgccgatgcccttctgaggattccaagggtggaataatcgatttcaaggtattcttcggaggaggaataatcactgtagccaatttccccgctttgaaaatggctgccaggatagggcctgccgtccagaatcagggcgctgccgataccggtaccgagggtgatgcacagcaggacacggctgccccggccgctgcccagccagtattcccccaaagcggcggccgtgccgtcattcataatggataccttgagagacggattgcgctgccggaggaatccgggaatatccacaccctttaaatagggcagattttccacaccgcccatacacagcccgtccgaatggataaaacccgggcaggacaagcccacgtttacagcgccgcaggcaaagccctcatcgatgacaggcagcagccgctggtagaattcatccagatttttaaggccggaggtggaaaaggaatttttccccgtgagccggccatcggccgtaacataagcatatttggcggaggttccgccgatatcaatggatagtgaaaggttattctgcatataaatctcctgacatatttttagttttaagaaggcaaaagggctccttcagaataacagatctgtaatttcatctttttccagaagagcataaggactgaacgcgaacacggtcatccgctccagttctcccttcccgttctgttcccagttaatgggaagcagcctgtccgtaattctttcgtagattcttttcccggattccgtcgtctgcagcaggttccatatcaagccgcacagaacacagatgttattataaaagcgctcatagtcgctgtttagttcaaacatcatgctgcttatttcggaataaccgattgtcagcagcggataaatcagaggctggtagacaaggttccatttttccacaagagccttattccggagaaaagcgtcgatctgttccagcatacaggccgcgtggacaggaaggccatcgtgctttaaggacgctattttttcagcctgctgggctgtttttttactgctgtaggtgagctgttccggggtgagggcggaaatgatgtatttcatgctgcgcaggaagggctggtagtcctcgattacctttcgggaaattttgctccagatgaattcctggtattcgcttcggtttccggaaagatagggcgtccatataaaaagagggatgattctcttgtccagctccgtgaaatcatcggcggccgccttcttttcctcataggattccatgagctttaggctggcggcaagggaatcacagtcgattggggcgggattgttctcaaaatagcgggcaaggatgtccacattccgccgcatggtatcgatccgttttgtcagagtgtcaatctggcggtaaaaataataggaagcggttccgggaaaacgaaggatatggcggatatccgaaacgggaaaatccagcctgcgaagccgtgagataataatgagattgcgcacatcctcatctgaaaaatcatggtatccgttaaccggatcctccttcggagtgatcagcttctgggatatataaaattgaatggttcttctggaaagtcctgttttttgaatcacttctttaattctcatggacaccccttccttttacaaaaagctgccgctcatttgatgcaaaagtctccggctgcccggcatcacctaaagtgtacaccaggtgcacactttttggaaggcacattgtggataaaaatacatttcatgtaataatcccctgataattataacaaaagctgaataaaaaaacaccattgactgtacagattgtggatagtttataatgaaaatataagaaaaggaggacggcgcatatgtatgaaaaattattttctcccatcacaatcaaagggatggaactgaaaaaccgtgtcatcctgcccgcgatgggcacccgtatgagtgatcataaaatggtaacggataagctgatccggtatcatgtcgccagagtgaagggcggaaacggactgaatatggtagaggttgccagcgtggagccgttaagctcccccaagcagttcctttccattgcggaggatatgtatatcccggggctgaaaaagctgaccgacgccattcatgaggcgggcggcaaggcgggaatccagctttggcagggaagtatcgccgtgagctttgatccggctgcgataatgtatgtggcatcggatatgcctgtatcggcggagctgacgctgcccggcatcagcgtggaacagattcattacatagcggactgcttcggaaaggcggcggcaagagcggcagaagccggctttgactgtgtggaattccattgtgcccataactacctgcctcattccttcctgtcaggcggaatcaaccatcggacggacgaatatggcggatccctggaaaacagggcgcgtttccctttggaggctatccgtgccatccgcagtgcaatccctgaggatatgccgattttcatgcggattgatgcccatgatgattatctggaaaacggactgaccatagaagaggtggctcagttctgtaaatgggcaaaggaagcaggagtggatgtcctggatatctccagaggaaatattataacgcctgcattgaaatatgaggtgccttcccttgatttgccctgcggcttcaacattgacaatgcggcatatatcaggaaagaaacaggtatgctgacggtcggtgtgggcagaatcaatacgccggagctggcggagcagatcctggaagaagacaaggtggatatggtggttatcggcaggggacagctggcggatcctgaattctgcaacaaggcaaaatcgggaaaaagagaggacatcgtaacctgtgtgggctgtgaccagggctgctatgacggcttttccaatctggatatgccccatatcacctgcctgagaaatccggcggtgggactggaagcggagctggaaccggttccctgtgaagagccggaaaaggtgctcatcgcaggcggcggaatcgccggaatgcaggcggcactgatattaaaggaacgcggtgccagacctgtgatttatgaaagcggcgatcatctgggaggacagttccttctggcaggggaagctccccgcaaacaggaaatgaaggcggccatgctttccatggcatcccaggtaaaaagagcgggaattgaggtgcacctgaatacaccggcaactcctgaattgattgcggaggaaaagccgcataccgtaatctgtgcgattggttcctcaccgatcagcctgaaaattcccggtgcggacggggaaaatgtggtgaattcccatcaggtactgggcgggaaggtgaaggtttccggcactgcggtggtaatcggcggcggccttgtgggtatggaagcggcggaatatctggcggaaaatggctgtaaggttaccgttcttgaaatgcttccggaggtatgcgctgatatcgggcctgtccggaaaatctgtgttatggaagaaatagcaaaacgtggaatcgccaccgttacaaatatcacggtcaacaggattgagaacggatgtgtttatggaagcaaggatggtaaagaagagtcctacccctgcgattatgcggttgttgcggttggttccagaagcaatgactcatccgcattggaagaaagctgccgcagtgagggcatcgcttttgtgaaggttggggatgcgctccgcgcccgccgtgcgatgaatgccacctttgaagcgcaggaagcggcagtgaaattcgaccagccggaataccgtgcggcgatttccaaagcgcccaggaccgtttttgtaacaggcggcaccggaaagatgggaattgaaacggtgaaacagctgctggcaaggaaacccaaatttgcggtccgtatgctggcccgtccatccgccaagaacaaagagcttgtgaagaagatagcagatccttatctggaagtgatctggggagatatgaaggattacgaaaccattttgaaatgtgtgacaggcgcggattatgtgctgcacatcggagccatggtatctcccgcggcggataagtatccggaagagacgctgtatacgaatattggctccacgctgaatattattaaggccattaaggaacagccggatccggacaaggtgaaatttgcctatgtgggtactgtggccatgacaggtgataggccggtgcctgtaaactggggacgctgcggggatcccatcaatccttccgcacatgattactacgcgatgtcaaaggtgttttccgagctttccgtatttgacagcggccttaaatattgggtttccattcgtcagaccgggcagtatccgccggatcagggagcgggcgaggaaccgattcagcatcaccagaaccccaacaatgttctggaatggagcaccgcggtggaatccggtatctgtatggcaaatctctgcgaagactgggtgtctgaagaattctggagaaaggcctataatttaagcagcggcaagggatggcgttttgcccattgggaactgatgaatttcagcttcgggcctatgggaatccgttatcaggatgtgtttgacgtgacaaaatgtgcgctttacaacttccatgggcagtactatacggattccgatctgctggatgactatttacatttcagggtaattcctccggaaagctaccgggcggaggttacggcggagatggaagcgatgatgaagaaccccatgattgccgcaatgatgcctaatacgcagtccatgaaggagaatctggaaaaaatcagccataaggagatgggaacctcctggatgctggaaaaggatcaggaagactggattcatgcatttttcggctccagggaaaaacagcagcagattaagactatggaggaaggatatgagttttatcatccttcggaggaaaatccggtttatatggatcatggctatgatgaaaataaggctttggaagatctggatgctgaggatatcaggaaagcggcatggttcagaggctgtgagctgctggacgaaaccatccccgacatttatacgcctatccggttcagatgttcgcagggacatgagtataaaatgagcgtcaacgcaatgctgcgcggcggacactggtgtccggaatgccagcggaacacctggcactatgcagatatggcccgtaagagcccgttctatgcgcaggtctggacgccggtacatggaaatgaggacgactacagtatacccatgcgtttctccgcatttgatatctggaatgaactgaaggataaactgggtcttgtataagaaaatgtaaaaagataatactcaacagggggacggcggctcacacgggcgctgtccccctcattttttcagcaaaaacaaattattactaatcaaaatgatatatggtaatttcttccgcataaaatacagaaccgttgcgggtgcctgtagcgtacatactccttcctatttccaaatcagcggcggttgcctcactggtagtggaagtaatacccatatcggaagaagaacagatggtaaataccgtatcctccgtataggttacctcaatggaagctgtcggatcggggtcagcgggagagacagcaagcaattcatcctcattcagaacctccacaaaggttttactgactctgaagctggacgagtcgatttcttcaatggttccatctaacatgtctttggaaaccgaggtttcatccgaagctgtttcctgagcttcggatgaggatatcccttccggtgcttcggccgaagcgtcaggctcagaaacggcttcaccggtattctccacagatgcagaagacgctcccggatctccagaagcggcctccgccttatctcctgaaccgcatgcactcaaaagcagcgcacacaacaataaggcggacagtctgcaaaaaatattgtcctttgttctttccatcacttttttcatttgtttccttcctctcattttcatattggttattaaccaaaaatatcataacagcgaattctctaaagtatttctaaacgagcaatccctttcctcccggccctccctcctgcacaccgtgtccctgtcctttgccctggcccctgccctttccggaaaccgtccggcggcacacctctctgcctgtcggctgcatctcaaaaaatgggagcagtttcttactgttttgtgccgatactccgctgcctgttcttagcggcgttgcttgacgaccaaagggaggagttcagccgcgttggcagcggagtattggtacaaaacagttagaaacgcccctttttttgtctgcagccgacaggcagagaggtgtgccgccggacggtttccggaaagggcaggggccagggcaaaggacagggacacggtgcgcaggagggagggccgggaggaaagggattactcgtatatacaataaaaacgacaaaaagcgacaattaccttgtgcactttatattttatgagtataattgatatcatatcgtttgtatgtgaggagaaggtccgatggttaagaaaaatgaaggtaatttaaagaaagcaatgaatgaattgctgggaatcgacggcgctgaaaaacgcagtgaagtgcaggcaggcggagcggaggaaaggaaagtggaggctgaaccggaaagagaaccggattctccggtgagtgaagagccggaacagcgggtacaggttccttctgcggcaggcgctgatatggcttccggcaggggaacgcaggtgagggcagagagctttgccatgcccgttatggatactcccaagatggagtcggttatcacctcagatgttattattgaaggaaatgtgcgatccggatcaaacctcaagatacttggtgagatcgtaggggatgtagcctgtgaaggacagataaccctgacgggtaatatcacaggagatgtgagagcatcctccctgcgttttaattccggaaatatccagggaaatgttactgttgtcaacgatgtcactgtggaaaagcagtctcatataaaaggagatattacggctggcagccttatatttaacggctctgcggaaggcaatctgatgatttcccagaatatggagctgagggaatcctcagtggttataggaaatgtatctgcagattgtgtttccatgtataatggcgccagattaaaaggcctgctggatgttggcggctctgaaaagtgagagggttgttgacatgtcggatatggaaatgcagcttgaggccgctccgcaagaaaaccgcgaaggaaggccttatttggggagtgtagccttttataaacatgtaatattgttttttgtatttcttttgtttgtattgctgaccggaaccgttattttcttttctgcacattatgtatctcttaagaaggattatgcagctgtctgtgaagagtaccggactgtttctcaggagcgggatgattataaaaaacagtttgctgccgctgcggctgaaagcggccgtgtgctgaaggatgatacagcaaaaacagacgttgtacgcggagatttttcgattccttttcatgcggatccggaggactggagatatcttctcatcaatgaggcccatccgctgaatcctgaatatacggtaaagctggcgccgacacggaacgggcagtttgtggatcagcgaattgtttaccagctggaaaagatgattgatgatgcggcaaaagaaggatattcccttattatctgttcttcctacagggattatgaaagacagaacgaactgcagaaggaatctatttcacagtatatggacaaggggctttcttatcacgatgcttttttccgggtaaagcgtacgctcgccttaaccggcacgagtgaacatcatacggggctttccgtagatattgtgggagaggattaccagtgccttgatgaggaacaggcgaagaggccggaagcgatctggctggcggaacattgtgccgagtatgggtttgttgtccgttatgacaggggaaaagaagatattaccggaatggattatgagtcctggcatttccgttatgtgggaaaagaggcggctgccttcatggaggagtatgatctctgcctggaggaattttcggatatggttgaattttttcaccggcccgatgaaagtgaataaattgtggctcatataaattataattaaaaagaaaaagaaatgggatttgcttgtacgatccacgtttctttttctttttttataggaattcccaaagataattattaaattgtttagtaaacaaaacttggtaatccctgttttgatatctgtttttagaaggaaatacaaagaaatagtgttaatatttatgcaaaaaagagaaaataagttgacatattgtacatataactcacttgaagtataataagattgtagaaaatgtttactaaactaattggaaacggaggtgaaaggatggcaacagtgagggacattgcggaaaagacaggctactctaaagctacggtatcgagggtgctcagcggggatcctacattcaatgcttcagaggaaaccatacagaaaattcagctttgtgcaaaggaattgaattatgaatataaaggcagaggaaaggctttgaaaataaggaacctgaaagagcacagggtcggaattattccgattggactggagtcttcaggtcggggcgagcttcaggatccttattatctttacatcagggatggtgtggaaggccggctgaatgaactggggtttcacaatgtatcccttctgccggtcaatgggccggaggattaccagaggctggaaagtgtggacagcattattgtaatcgggaaaaaatcatttctggaggaaaatgtttactttaagaatctgaaaaatgttatttttgttgattacgattttgactaccacaaatatgattgtgtcctgagcgattttacggatgcggtaacaatggcaatggattatatggcagagtgcggaatgcggaaaatcggatatatcggaagctgggattatgtaaatgacttttccaatgacaggtttatccgaaagatggacagcagacaggaagcatttgaaaagtatgctgagttaaaagaactcacctataaaccatacctgtatatcggcgagaaatttaccagagctgtcggatatgagctggctcagaaggccattcagtcgggacagctgccggaagctttcctgataggtgcggatcctatggcaatgggcgtgtacagggctttttctgaagcgggaatccggattggaaaagatatcaggatgatcagtattgataacattgaggatacagaatatctgtcaccgccgctgacgactgtgatgatacaggcttatcagatgggaagatgtgccgtggatttactggaacagcgtctggcaggaagaacggttcccgtgaaagtggtattgcccgcatccttagttgtgagagaaagctgtcggaaagaaagcaaaaagaaacaaaaccgttaaaaaagagtcattttctgaaacaggaacagtggggactgataacgagtttacaaaaaatgacatatacattatacctgctatggccaggaatgtaaagaaaagtgaggaaaacatatatgaatataaagaaaaaattatcagcagcagtattaattatttccgtatttgcagcagcattggctggctgcggcggggcgaagcctgcggaagaagcagcggctcctaccgcggcaaagcaggaggaaatgacggcggaaaacaaagagggtacaggcggcaagatagtgtttgcatactggggagcagaaagcgaaaataatgccattcagaccgcagtgaatgctttccgtgccagtcatcctgaaattgaggtggagacacaatggattgaatcggattatctgacaaaggtacagacacagattgcaggagaaacaacggcagatgtttatcttatttcagcaggtgatcttccgggatttgcttcgaattttgatacacagacggtggatgcgtccaaatatctgtcggaaaatgtgatcgaagcgcttcagagtgaaggtgagcttaaggcgagaccgtttatcatcaagcctaaggtaatggcggtgaataaggatttgcttaaagcgggcggtgtggaaatgccggcactggatactccgatgactgttgatgaatttaaaacagcaattgccgctttaagtgatccgaatgcggatccgcagagattcggcagtgaatctccctggatgggaaacctgatttatgcattcggcggttcttattataaaaacaatgggacggaaagtaatctggattcccaagaagtgattgccgctgctgattttgttattgacgccagagaaaaaggctatgtacctgacagtatccaagcgcagggacagagtatgatggactggtttttaagcggaagaatcgttttttatacggatttcggcccctggtatatccctcagatggaggaagtgagctttgactgggaattactgccctatttcggcaacggcggcaacaaggaagtagacggcctggctatctgcagtgcttcaaataataaggaagcagcggaggtatttgtgacttatatgtgtgaggatgaatctgcgcagaaagcgattggcggtgattccagcgcttatggcgttcccgtcaatgcggaggctgttacagcattcgagaatatctatccggaaaagaatatgtatgcctatgtatatgcggcttataaccagacaccgcaggaaacacagaagagaaccaatgaaatcagttctgtaatgagcagggtggatgatgagaccggagttggtaccggcacggataaacctgaggatgtattcccggatattgcagcggaaatcaatgaaattcttcagcagtagtctttaaacaggcgccgcctgcccatgacctattgtctggccgggcggcgatgtaaataatggaggaacgggatgaattggatatctaaaataaacggtgtgtttaaagtaatgggcttatctataaatgctgcctctctctgcacctttttcagcgtggtcatattattttttgtcattctctatgggattcttcaggtattatttaaaaagaaaaagattgattccactacaaaaagtttttatctatttgtggggccatgggtatttggttttctgatgtttacgctggggccaatgatttattcctttaccatgagcttttttgactgggagctggtaaccgagcctgttttcagcggtctgaataattatgcgaagcttcttaccgacaagcatgtagcacagtcgttaaaagtgacttttatttatacgtttgtggcggttcctctgcaggtagtgctggcttttttgctggcggcacttcttaataataaaatacgaggaattaacgtattccggactattttttatctgccgaatctgatttcaggggtgccccagatggttttgttcatgtgggtgttcaatccgaacttcggccttattaactctgcactgaaaatgcttggtattcaagggcccggctggttttccgatccggcctggtcgctcccggctgtcattatcatgagcctgtggacggtgggaggcagtatggtcatttatctggcaggtttccaggatatttcggtgagcctgtatgagcaggcatccatcgacggagcaaacgggtttaagaaatttatttccatcacgattccccagatgacgcctatcatttttttcaatatgataacagccatgatcggagcattccagacctttacacaggggtatatggtggacggaggcatcaaggattcggttcttttctttgcctattatctgtatgaaaatgcctttaaatggttcaaaatggggtacggctgtgctctggcatgggtattgttcctgattattatggtatttacgctcattgttttcagaagcagtgatatgtgggtttattatgaaaatgagatgatgcctgccaaaaagaagaaaaggaaggtaggaaaataatatgtccaagtctaaaaataaaagaataaaaacgattctggtacttgccgtgcttattttcggcgctgtgatttttctgtatccattgctgtggatgcttgcttcttccttccgaagtctggaagaaattgcggtaaaaggaatgaatctgataccggagaaaatgacgctgaaatattatcagaaggccttgacttccttctcgttttttacatattttaagaattctctgatagtctcgggaatttctatcgtggcgacagtgatttccaattctatgattggctacgcctttgcgcggtttaaggtgagggggagtaatttcctgtttatgctggtattggcgaccatgctgctgcccggcgaggtcatgcagattcccagatttatcatgttcaagaattttggtatgctggatactctgtatcctttgtttattaccaagttttttggaagtgcattctatatctttttattccggcaattttattccagactgcccggcagcctggaggaagcggccagactggacggatgcagctattttggtatctggacgaaaattttcatcccgctttcccttccgatctgtacctctgttggaatcatggaatttatgggatcttggaatagctttaatgatccgctgatttatatcaacagtgaccggtggaaaacacttccactcggactggcaggtttccagggaacttactccaccgacaccaatcttttgatggcggcatcgctgattgtaattctgccctgtattatcctgttcttctgtgcgcagaaggcatttgtggaaggggttaccttttccggaggcaaagaataaaggagactgttattttaatgaaaaaatataaatatgggaatctggaattttcctgttctctttctgaattaaacagaggattttcctgggcaaaggaacaggcgctcgcctatgttcatgacggggaagatcctgtgggtttgtggtatgaggcggcgctgcctgcaagagatgccttttgtatgcgggataccgcacatcatgcacagggcgcggcagccctcgggctttccgctcatacgaaaaatatgctttatcggtttgctgaaagcatcagtgaggaaaaggactggtgcggctggtgggagatcacgaaagcaggagaaccctgtccggatgattatgacagcgacggtgatttctggtataatttccctggaagctttgaagtgattgcagcctgctggcaggaatatctgcgtactggtgaccgggacttcattacagatcctgttttcagccgttattatgagctgacctgtaccaggcttgtggagtactgggataaggatggagacgggcttttagagcattatccggagtatggccgaagggggctggcgtcatataatgaaggagacacggctattctgacggcaggggatatgctggcgagtcagtgggcagcttacggagcttacagcgaaatcctggaacgtcagggcaaagaagcagaggcggctgcttatcggcagaagcaggaggtgttgaagcaaagatacctgacggaatggtatgatgataaagtaggcagattttatggcgcggttctgcaggacggaagtttttatcagggttattataaggaaggaaatttccttcccatttactttggtattcttgatggggaaggacttctggaaaaagcttatgagcagcttgttaagaatccgccggaaaatgtggaaggaatgtcttatatgccgcagattttttatgcctgcggggatgaaaaaagagggctggaggccttaaagaagcttggagatcccaaccttccgcgcagggaatatccggaggtttccttcgcctatataggtgctgtggcaggctgcgtgatgggaatagaggcagccgagggcacgattgttacgaagagcggaataccggaaggagaaacggcagaaatccggaaacttcctgtttttggcggcacaatttgtgtgaaacaggaaggaaaaaccggttcggtgttccgtaatgagacaggaagcacacaaatctggaaggctgtttttgaaggagaatgcagggaaatgtatctggacggaaggaaggcagcatttgagaacggaagagattcggcaggaaaacctatatcctttctttttacagaggtaatgcccatgcaggagataaaaattcaggcgatgaggtgggaaaaatgatagaagaaaatattgttcccccgattcaggtctcagttctgcatcctgcctttcaggaaaaggaggagagctgggaacagagtggggaagccgtatggaaatacagtctgcatttttcccacacgtgcggaatgacagagggaaaaggaattatgattacctggaaggtccccattctggatatcctataccgctggcatccggtctgcgggaccgatcgtttcctgaaagcggattgggacagtccgctgcgtactatgaatgcggtatctgcgccggttgtctgcatgataaacggagaggatgaaaaccggtttacggcagcgctgtctgaaacacagaaaattgtttatatgggagccggtgtccatgaagaagatgggacactgctgtttgatgtgacaataaatgcagcggaactggaaaaggaagatacttacgatattatattgtatatcagcagggaaaagataaagctatggcagatactggacagagtgcgccagtggtgggaactggaaaatatggtttttcccatgacggtgcctgatttcgcacggtatccaatgtattctacctggtactcttttcatcaggacataagtgacaccaggctggaggaagaggctgcacgtgcaaagaaactgggcttttccactataattgtggatgatggatggcagacaaatgatcataacagaggctatgctttctgcggtgactgggaacctcagccagagaaattcccttccatgcaggaacatgtggagcgaattcatcaaatgggtatgaagtatatgatttggttcagtgttccgttcctgggtatacatgctaagcgctggaaggatttttctgataaaattatctggtttgatgaatcgcggcaggctggggtactggatatccgtttccctcagatacgggaatatctgcttcaattttataagagagccgtggcagaatggaaagttgacgggctgaaattggatttcattgatgaattctatttccgcagtgatacggcagcggaaaaggaagggattacctgccggagcgtgcaggaggcattggaactgctgcttactgaagttacggcagaattaaagaaatataattcggatatcatgattgaattccgacagcgctatatcggtccgggaatacgtccctatggaaatatatttcgtgtatctgactgcccggaatcaggaagcactaacaggcttggaattgtggatttgcggatgctctccggcagtacagcgattcactccgatatgatgatgtggaatccggatgaaataccggaggatatagccattcagctgcagaattccatttttgcaacaccgcaggtttctgtctgtcttgaatcgctttcagacagacaaaggcaaacattggttttctggatgaaattttgtgaggagcatatggagctcctgcagaaagcgcaaattatgccgcaggaagcagggtatctgtatcctgttgtgcggacaaaaacggaaagggaagaactggctgcggtctatgcgccggacaaggttattacgttggatccggcggttggtaagcatactattatctgggccaacaaatcggaatatgcctttattcggatggaatacagctgcagtgtacatatctgtatcagggattgcctgggggaggtaacggaagataagaaacttattttgacagaatgccagaggcttccggtgtgcccgggaggtctgcttgagatctcttcttaaaaaaggaataagcaacaggccatggaaccgcagaatcagggaatcatggcctgtttgcatatggttacctttctcttttttaaacagaacaaattcttttttctccatacatgattcaaaatccgttattctgcagaaaatagaaaaagtaatattgcagattttataaaaacagccgtatgagcagctgtattactaaatcaaacggaaaaaggaaaataaagaggagaaaacgagatggcgattgactatcggaaaacagccggcgagcttgtcagagaacttggcggaaatgaaaacatcatcaatgtcacacattgtgcgaccagactcagattcatattgaaggatgagtctgttgtggataaagacaaagtcgcaaaagtcccgggcgtcattactaccgtgcaggccggaggccagttccaggtagttattggaaatcatgtaaaggatgcgtatgggtttgtaacgcagctggtcagtatagatgaagaagaggcgcagaagagcggcgggcagaaagccggcatttttacgcggattgtggatgtcatatccgcaatttttgctccgtttctgtatacactggcggcctgcggtatcctgcaggggattctgggcgtgctggctgccatgaatcttattaatacagcgggcggaacctatcagatcctgaattttatatcctggacggcatttaccttcctgccggtcatgatagcggtgacggcggccaaaaaattcggagtgaatacttttattgcgatcgtaattgcatgtgctctggtgagcccggattacatggccatggtcaatgcgggagagccggtatacttccttggaatcagggttcagctgttaagctatacttcttccgttattcccattattctggcaatctggattgcttcgtatgtggaacgtttctttgaaaagtatctgcccctggtagtgaggaatctgttcacaccgatgtttaccattgccgtcatggtgccgcttaccctgctggccttcggacccgtgggtaatacaatcggcggtgctatcggtgatgtttataattttctgtatggattgagccctattgtggcgggtattattgtgggcggcctttgggaggtattggttatattcggcgtacattggggaatcacacccgttacggtgggaaattatgccgcactgggatatgatacttttaccggccttcaggcagcagccgtattttcccaggcaggcgcagcccttggtgtgttcctgaaaacaaaggataaagaaatgaagggaatttccgcttctgcggccattacagggctttttggtattacggagcctgccatttatggcgtgaacctgcgtctgaaaagacccatgatctgcggatgtattgcaggcgctgtgggcggagcggtcgcaggcgcattccgtgcggtgtcctggggctataatatgcccgggatcgccacccttcctgcctattttaaagcagggcatatgtcccagtttacaggacttttgctatccgtcctgatcgcctttgtattgggaatcgtttttacctatattgccggatttaaggaagaagcagccgaagccgttgtgcggaatgcggaaaatgcagaggtgccggaaggctgtgaaacgaatataaaggtttccaaagcaaacacagagaatacagaactggcttctcctgttaccgggaatgtaattcctttaaatagggtaagggatgaggcctttgcttccggggcgctggggaacggcgtgggcatacagccggaggaaggcaggatttacgcgccctttgacggaaccgcgacggtggtatttcctaccggacatgccgttggcctgacggacagaagaggaaatgaatttttaatccatatcggtattgacacggttaagctgggcggaaaaggctttacggctcatatcagccagggcgatatggtaaaaagaggggatctgcttgtggaatttgataaaaagaaactggaaaaagagggatatgacagtaccgttatttatattgtaacggatacggacagagcagtggaaacagggacaggcaggcatgaggccttaaccgataccataatgagtttaaaataaaggagtaaaaagatgcgtacattaccggagaattttttgtggggaggcgctattgccgcccatcagatagaaggcggatgggataagggaggcaaaggtgtaagcattgccgatgtgcttaccgccgggggccacggagtggatcgtaagataacgaacggcgttctggaaggatattattatccgaaccatgaggcttcggatttttatgggaaatacaaggaagatatcaagctcctggcggagatgggattcaagtgtctgcgcacctccatcgcgtggacgaggatttttccgaagggcgacgaagaggcgcctgatgaggaggggcttatgttctatgacaagctctttgacgaactcctgaaatatggaatagagcctgtggtaaccctttcccattttgaaatgccttatcatctggtgaagaattacggcggctggaaaaaccggaaggtgattgatttttttgtgaaatattcccttacagtcatggaacggtataaagataaggtgaagtactggatgacattcaatgaaattaacaaccagaaaaattacaagtaccctttgtttggctatacctgttccggagtgatatttaacgacgatccccacccggaacagtgcatgtaccaggtggtccatcatgaactggttgccagcgccctggtggtaaaggaagggcacaggatcaatccggatttcaaaatcggctgtatgatggcctgtgttccgctgtatccgtattcctgcaatcccgaggatatgatgtattccgtggaagccatgcatgatcggtatctgttcggtgatgttcatgtgaggggatattatccctcatatgtatggccggaatgggagcgcaaaaacattcatgtgaagatggagcctcaggatgaaaggattctcagtgaggggaccgtggattatgtgggaatgagctactatatgacgaatgccgtaaaggcaggcgccgtggcgaaaggaaacggactggacggcttcccgggaagtgtgccgaacccttatgttaaggccagtgaatggggctggcagattgatcccgtgggactgcgctacgcgctgaacctgctgtacgagcgttatcagatccccctttttattgtggaaaatggttttggagccgtggataaaatagaggcggacgggagcatccgtgacgattaccgtatagaatatctgaaagcgcatattgaagaaatgaagaaggccgtcatacaggacggcgtggatttgataggctatacaccctggggatgtattgactgtgtatcgtttacaacaggagagatgaaaaaaaggtacggttttatctatgttgataaagacaatgaaggaaacggaacgctggagaggaagaaaaagaaatccttttcctggtataagaaggtgattgaaagcaatggagaggatttggatttctaagctgtaagcgccgctgcgctgctggaatatctgcgcggaacagataaaagaaagtcgaatgtccgtcataagaggaaaacggacggaataataatggagtatatctgactgaggcaaaaactcacagatatactctttttttcttttcggatactcttatttttttgaacaaataaccgatagaaataatagagtgtaacaaacggagacaggagaggggagggactgctcattatgattagagccgagtcttgtcaatttggaaaaaacctgtatatgtatcccggtgaaagagcggcggatgccttaaaacagacggaacttcctttagcgttcaatgacagagtcaagacaaaagacgtcatgcgaagcagtgtacccgcaaacggggaaagcgggctcaaaacctccgatgcgttgaaggaagaggaatatatccgatatctggaatccttatttcccggaaggagtatttctgttgcagatttatcggggaaagacagcataaaggattatgccctttcccataagggcagcttccaaatcgtcatatccagggaaacgctggaaagaatgcagaaggatccggagtttgaaaaaaaatgtatggaagccctgaaatccgcaaggcaggagcaggcgggaaaactcggaaagctcccgtctcagggaaagcatctcctgggatgcggactggtattggataaagacggggaggtcacccaatgggtgctttcccagaaggatatacagccgaagccggtatccaatagttccggcatcaggaatgtgggtaaggaggatggttcttatttccgcataaggacggaaaaagggactatgacgatagaaaagaaaaagctgaggtatgtaccggcgaaggatctggtgaaaattgccagggcggggaaccgtcaggcggtccgcaggacgatatcaggaatccaggcacagataaaccagctgaaatcagggagcggggacagaaggacaaaggccgtactggtaaaacaggcggaacaggttctgctgaaggcaaagctgaaggataagctccttaaaaaagaagaaatactgcagctgcagcagaaaaaagcggcaaaaaaagcggaatatgaaaaaagcctccgtcttaagctgcttctgaaaaagaagcgcgagggacgtaaggtcagggaatatgggcaaatcagggattattatgaaacaccgcaggaacgaaggctggagaaagagctggaaaaatatgaaaacagcgtggaaacagatactacctgtcaggatcaaagttatggatcatatggggcggcagcagggatgggtccgtctgccggaggcgctgatatttcgatggcaggcggcatattggatataacggtctaaaaccgtaaaagaggcggacggacaaaacgcctgtaatttgtttcaggaggattatgtatgaagatatacgccgccaggcagcctgtttttgattcgaccgggaaattattcggttacgaattcttatacagggacagcgaccgtaatgaatttaacatggagatagacggcagtatggcgacctgcctgttgctttccaatatgctgagcgagtttgggctggagaatcttaccggtggcgtgtatgcttttgtcaacctgacgcaggagcttcttcggaacgaatacatcagtattatggatcccaagcatttcataatagaaatactggaggatattaatgatgattccaatctggaatccacactggcagcattccgggaaaaaggatatgtctttgccatggatgattatacgggggaagataataaggacaggctcatatcggtttcggatatcctcaaggtggatttccggctgacagataagaaggtacagaaaacaattgcgcagaagtataaggattccaagattctgctggcagaaaaaatagaaacagaggaagaacaaaaatgggccgtggataacggctattcccttttgcaggggtattattattccaaaccggtcctgctgtccaaggaaaaaacagaaattgcactgacaacctatatgcgtctgcttaaggaattttccaagcctgatacggatttcaccaagctggcggagattattatgatggatgtaaatctgtcctataaattcctgatgagggtgaataccctgcagtatggagggaaataccgggtaaaaacggtgaagcagtctttggtgcgtatggggctcatcgaagtgaggagatggaccttagccatattgctgagtgatgtattcggcaaaaaggataatgaaactgcaaaacgtgcgctgataagaggtgtttttgcagaaaaactggttagtctgatgaaacgggtggatttggaggaggaggcctacctggtgggtatgttctccacaatagatattaccgtccgtgataaccttgagaaccttttgaaacagatcaaggtttccgatgaatcaagggaagctttgtttttccgaagcggaatcctgggtgaagtactgaattttgtggaagattacgaaaacggaagatgggataagctgaatgagttcatgaggaaaaacaagcttaagcagagcaaaatttcatatgtctattttgaagccgtaaaatatgccgaaattatgtttgaggaatacggcagaggaggcataggagattatggctccttcatgcagaataagagcccgctgatagaaatgctgaataagcagcggagcagagaaatgaaggaaggggaagcggacaaatgatttcagggagagtttttccggaatatatgaaggaaatataaatcttatatgaaatatactttatttttttaacatatgcgccgataaaataaaataagaccgcttagggtggtgaaagagttcaacagaatacactggagtgacaggagaaagggatatggagatggatggaactgaaaaacttatgaatgaagaagctgctctgtccgaagaattgggaagtaagtatctgacctattttacagacggacagctctttggaattccgatagcggatgtggtacagattataggaatgcagaaaataactgagattccggagttcccggaatatgcaaaggggattattaatctgagaggagagatcatacctgttatcgatgtcagaatcaggctttataaaccggttatagaatatagcgaccgcacctgtatcattgtaacggatgtgaggggaagctatttcggatttgtggtggaacaggtggatgaagtggcggaaatcccggatgaactgattacacagcctccccgtatgggaaatgacgcggcggcccgttatctgacaggggttgccaaggtgaaggataaaattgttttacttatggatatcaagaagcttctgggagagcaggaatttgagagcctcgcacagacagcataccagagtgaaatatagttaaggagaaagcacaaatgagaaacttaaaaataggacaaaaattatccattacattcgaggttattcttatcttgcttcttgtcacggtaggtgttgcaatttacagcctcagcagtctttcaagcagttttacggatttttattcggttggatatcaggtgtcgcataaggcaattgatatgcgcaggacaatacagtctgcgattcaggatatcgctttcggcatgctggaaacagatcagcagaaagcacaggattattttgcagaggcagatacggaaatgcagattctgaaagaagaatttgattatatggagaagaattaccgcggcgataagagtgacgtcgcgaaggcgcttgagattatgagttccagcgtacagtacagaactgaggtgcaggatctggtaacacggggcagaagtgaggaagcggtggaagtgttctttaacagctataagcctctgttgacggaggcacaggatctgctggaaaagatggataattataccaccaatcttgctgcagatgattatgaagtatcgatgtctgacaaatcagcaaccatgattctgctgattattatatcagctgtggctttgctgacaaccatcattctggctgtggatgttacccgcagaatcaccaaaccgataaaagagattgaggcggcggtaaaggagatggcaggaggaaacctggatgttgccatcgcatatgaatccagggatgagctgggaagtctgtcaaacagtgtacgggaaatgacaggcaggctgaaagccattatctcagatgaggcttatgtccttggagaactggcaaccggcaatttcaatgtcttgtcaagaatggcagacagttatgttggtgcattccaggggattctggaagccatgagaggtatcaagaagagtcttaacgaaacgctgcgtcagattaaccagtccgccgatcaggtggcgagcggaagtgagcaggtatcctccggcgcccaggctttgtcacagggagccacggaacaggcctcttccattgaagaactggctgctactatcaatgagatttccgagcaggttaagagcaatgcggagaatgcgatggatgtaagcgcgaaagcggtgcagacaggcagacagatggcggaaagcaatggccagatgcaggaaatgatcgcggctatggaagaaatcagcaattcttccaatgaaataggaaagatcattaaaacaattgaggatatcgcattccagacgaatattcttgcactgaatgcagctgtggaagcggcgcgcgcaggcagtgccggaaaagggtttgcggttgttgcagatgaggtgcgtaaccttgcgagcaaatcggcagatgcttccaagagtacggcggctctgatagaggcttccctgaaggctgttgaaaacgggaccaggatagcaggccagacggcagacttcatgacggaagtagtggaaggaaccaaggttcttaccgaaaccattgacaagatctccgaagcatccaatgcacaggcttcttccattaaccaggtaacacagggcgtggatcagatttccagtgttgtccagacgaattctgcaacggctgaggaaagcgccgctgcaagcgaggagctttccggacaggcacagatcctgaaacgtctggtaggaagatttactttgcaggatgacggaacggcaaatactggtttcattacaggatgtgaggtgaatagctacgatactgtgccgggaggagcggcagccgtaagctcctttgacaacagcaaatactgattggagtatgagtcaaaaagctcacataagtttagggtaatggaacagaatgtataaaacggagggtaaatgaatgattaagaacctgaaaataagagtgaaattaatggttgcttttgcgattgtggtgaccttatgtacggcaatgatgatttacactatgtcaaagatggagaaagtaggaaaactgactgatcagctgtatcaaagcccgtttaccgtcagcacgcagagcagcatgatgcaggcgcagctgcagagaatgggacggggcatggttgagatgtgcctgtatgaagattccacctattttgatgatgtaatggaagcgggcgatataatcgcaaaaagcctgcctgttatccaggagcgttttttgggagaacagcagctgatagggaatgtgtcccaggatctggagaagctggaggctctgtcgaaggaaatcaaccagctcattttgaacggaagagccaatgaagcgcagcagaagctgatggcggaatacaaacctatttttgaatctgcgctggacgatgcacagaagattgtggacagttcaatgaacagggcgctggaattcaataataatgccagtgcaaccctgaaaagttcaagcaatctggcgcttattctgatgattatcctggatatcctgtgtgtggtgattgcaattgtactttccagagcaatctgccgtccggttctgcagatcagggatgccgcaggcaagcttgccgccggctctctggatatcaaggtggattattattccaaggatgagctgggtattctggcggaagccttccgggaaatgagcgcttacataaaagcggttatcaatgatgttgatatgcagctgggagcgatcggtaagggtgattttacagttatgcctcaggcggaatatgtgggagactatgttcctattaaagaagcgattataaacattacagacaatctgtcaaggacgctgaaccaaatcaatcagtcatccagtcaggtatcggcaggaagtgagcaggtttcttcaggcgctcaggcactttcccagggagctaccgaacaggccagctctgtggaagaactggcggctaccattaatgaaatatccacccagatcagggaaagctctgaaaatgcccgtcacggcaatgaactggcagaggatgccggtgtgaagattgaagaaggtaatcatcagatgcaggaaatgattgatgccatgggtgaaatcagtgaaaaatctggccagatcagtaaaattatcaaaacgattgaagatattgcattccagaccaatattcttgcactgaatgctgccgttgaagcggcccgtgccggtgtggcaggcaaaggctttgctgttgtggcggatgaggtgcgtaaccttgccagcaagtcagcagaggcgtcaaagagtacggcagcgctgatagaaggctctatccatgcggtggagagaggaaccaagctggcggatgctacggcacataccctgacggaaatcgtggataatgcgaagaaggtagtggtggttgtggataatatttcacaggccgccagcgaacaggcatccgctattgcccaggttacacagggaattgatcagatttccagcgttgtccagactaactcggctaccgctgaagaaagcgccgctgctagtgaagagctttccggacaggcacagatgctgaagaatctggtgagccagttcaggctgaagcagctgggcggagagtcctatgcaatggaaaatgagttatacgacagcccgatcaatgattacagcagtcagcagtcagcatcctattatgattccaaatattgatttcttaattaatatctgattatatgaacagtaagccgcgttctctgcatagggaacgcggtatttttatgtccaaaaagcgaagattcattcatcgcgcatgcaggaaaaggtgtataaatctgtcataatttcccggagtaagcatatatttatattatattgacacgaaaggagagattcagaatgaaaaaagatgataacaagaaaagcagaatgggacaggctatggggattctgcatattacaggatatatcgtggcggctgcagccgttatggtatttcttacaatcctttgctatgcctttgtcaaagatgagaatctgataggggaaagcgcggaaagcaggctgcagctcatgctgtatgcattcggatggctgctggtcctgctgacgattatattgtgcgggacgtggattctgctcacttttatgagggcttttatggatgtgataggttcggtatttgatgaaaacaggaagatagatgtaaggaatccgtcttttctgaagatgctgagtatctttttgtttatactgattgccgcgtacctggtgcttcccggagaaaggttcgacgggtggctggccttgtttgaaaacgcgggaggcctgacggtgccgcttctggcagccgcggcactggcggcaggctatgtgggggtacatgtgatatacaagctgctggaggcctttatcaataaggaaagcgggctgaaaaaatatatggaccgggtagcccgcataataatgggaatggccggggatttgcttttatgtctgctgcagttcgtaaagtttgtgccggaatttatgaactggggatatgatttaatccgtgcggatgatgaggaagaaatggatgaggagatacaggaggaactgggatgaaccggataaagaaaaaagaaacggaattctggaattttattaatatatgttctgtctttctggcttttatttccctgtatactacggcagagggcatgaaccgcttctttttcagggaggacaggatccatggctatctgatatccctggcggttcaggggatactgctttccctgaacctccggctgcccagatatctgatgggaaaagccctgcccgcaaaggcctgtgccatagggctgtatgttttcactgttttgtggtcatccggcttcagctacatatttatgtccaatgttatttatcaggatacctggatgaaggatgcccagatagagatgacaggcctttatcaggaagggaaacagaaactgacggtacaggcgggagaagccatggaaaaggctgtgggagaggtccttggggatgtaaccgcttttaaaagcagggcggttcaaaatgacggaacagtcctgactgcgggtacttcggtggagtatcagaattatcttcctctgtttgcggaggatccccgtatgctgcaggccatttatgccctgcaggaaggaaaaagcgcatccggggaggtctccgtcattctggatacgctaaaagaaaaagaagagacattgaccggggaactggaggcggttacgcagaagctggaggaaacggacagcaagctctcccagctggatcagcagaggacggagctgattgacaaacggacgaaggttgccgcaggctcggacgcccatagcagctataccgactccatcaatgagaaaacggaaagcattcgttccctgaaggatgaaaaagaaaatgatgcgaaggaagcgcaggaaatccgggacaggctccgtgcggtgcagtccatgctgtccgccggacagctgacacaaaacagtgcgtccgggcagacggatcaggacttcgcgggaataatggcccagctggggagtacggaaccggatctcgaggaaatagggcggctgaccgataatatctatgccaccctcgtcggcggaacccaggcaggtcagaacatggaagaatatgaacagcttctggaagattatctgaagctgcggtcagatttgggaacagcctcggatatcagaggagttattgcctggctggaggaggaagacactgttgcggaagaaacagagaggcttgttaaaatggacggcggagaggaagggctgaatctgtggagagacacctggaaccaggcgctgacagggctgaaaagccaggtactgcttatccctgaggatatagacgtaacggatacggtacagacagggaaaaaggcggaacaatggaagaaggagagggaaaagcttctgggaggcattacggggatgcagagaaattatctgctggaattaaacgatgtggaaaaggccggtaactatctgttcggaagctttccggccatggcatggttttctctgttgtttgccatttatctggataccgcgcccatgcttcttgcagtgttcaaatattgcagtgcaaagcgggtaaaagaagacgggaaagagaaaacgaagagcatggttttcaggacggcaatcggagccggctgtatggcatttgtgatacttaattccatcattcttatgagatttttctgactgacataacggcggaaatacacagaaaacgcggggaaaataccccgcgttttttgtgctgcggcaggctttaaaaaaatattatttttttttctaaaaatactaaaaaaacttaattaattaaaaatcatgacgatatagtatttgaacacagttggatgaacttgttcccaagtgtttatctggcaatggcgcgccaaagaagttcattgtttcaggtggaaactattgtttcacaccacactaattctaagggaaaaggatttcccttacataattacatggaggtatatttatgagaattcaacacaacatcgcagcattaaactcttacagaaaccttagcggaaacaacaatgctgtatcaaagaaccttgaaaaactgtcttccggttacagaatcaaccgtgcaggtgatgatgccgctggtctggctatctctgaaaagatgagagcacagattaccggtctgaagacagcacagaagaacgccaacgatggtatctctcttgttcagacagcagaaggcgctcttacagaagttcattccatgctgaatcgtatggttgagctggctgaccagtctgcaaacggaacctatgacaacaaggttgaccgtgcaaacctgcagaaggaactggattccctgaaatctgaaatcgatcgtatttctgaaggaaccaacttcaacggaattaacctgctggatggctctctgagcggatccaaggcaggcggcgggatgacaggtgcatctattgttaattataaggctgctactgctgttggaataggtggcgtggatgccagtgcagcaggtgctatagattggtcacataaagatacagtagttgtagatggtactgaaatagaagttgactggtctgttcttgatacagatgagcaggcagcacttgcaaaaaactggtctgctggagcgactgctactgatactaagaaggcagcagaaattattcagaaaacagtaaatgatgctattgataaatataacacccagtatggtgcatctgttgctaatatcacagtaaaggcaaatggtactgccggtaaatttgatataaccagtggccagaaagatggcaattctaatgtaacgattaagtatgatgctgcaaataataaagctgcattgggtattatatcgggtgcggtagctggtactgcagatgtatcaacagcagcaccgattgcttcagcaaagaatgctttggctgattatgctggtaaattcactatgacgattgatggtgaagaatattctattacaacaggtacacctggtgctgtgggaaatattgcttctgaattacaggatgcaatcgatcaaactttagctgattatgatacggcaaaaggcactacgggtactgatgatgctatcgcaggtaaaataactgtaaaattaaatgcaaacggtgcacttgaatttaccaataccagtggtaagaaaattggttttgctgatgtagatggcggtacaactgctgcaactctgggaatttcttcagagggcaagaacagcatgaacggcggccttacccttcagattggtgataccgcagcagatttcaatcagctgacagtttctgttggtgatatgagctccaactctcttggaatcggcggaatcagcattgctacacagtccggagcaaaagcggctgtagataagatcaaatccgctatcaactccgtatcttccacccgtggtgatctgggtgctatccagaatcgtctggagcacaccatcaacaacctgggtgtaaccacagagaacatgaccgcagcagaaagccgtatccgtgacgttgacatggctgatgagatgatgtcttataccaagaataatatcctggttcaggcttctcaggctatgcttgctcaggctaatcagctgcctcagggtgttcttcagttattacagtaatatcagtcataatatattgcattttaatcagtcataatatattacatttatatcagtcataatatcagattacagtttaatcagtcataagttatacgacagtttaatcagtcataatgatatacctgtatcatctgtaaaattaaggatgagcgctgcctggcaacaggcaggcagctatcacaggcgttccacagccaggctggaacgcctgttttagtgtttaacgaactgcagcataaagagtaacagaagaaaaggaatactcctccggacgaattgtaccagaggagtattccttttcttttcttcttatatatgccgcattacagcttctgcagaacaaattctatcgttccttcttcttcgatccggcgccggctgataatatcgaaaccaaggatatctttcaggtattcgatgccctgcgggaataaaaaaacgttcgtatctgccgattccggaaggggagtgcccttcataaccagcttcagaaggtcaacgcccagattccttacttcaaaccataagatacctgagtcatccaggtagtataacgcattttccaataacttttttaaatctgcggaacggccgggatgctcaatgaggacggcctgaaagcagccctgtaattcttctgagaaagaacgatcctccagctgtttcagggagcacctctgaatgatgtaattgttatcatccaatgcggatgtaaaggcattgttattttcacctgcaaacagcagaaaaccgcccttcatatgctcctttaccacttcggctatacggatatatctgttggagcctgtatcggcgtcagccggtacggggaaaggatagggtgaattttttaccgcatagcagttcagacagccgggacactgcatccacaaacgggaaacagaggcagaaccatccgaaccgccggtattacggtagaaataggcggtataaaagggattcccgggcttatcgcagacaggacacctctgtgactcggcagtccacagcatttgtatggttctgaggacagaggtatgccaatggcttacgatggatgcgaaatccccggaatacagatataagtcgttttcaacgcaggatcggaaaagccgggtcgcctgtatggcagagtaggctttgaaagattccagactcgcctcaagagtattcaggccggtaacagtatcctgcttcagaaagtgatcttcactatattcgttcaaatgttcagcgctctccgcgatagttttgcataaggcaaacatcatggataaatgctttttccctttaacagacattcttatatctccggtattttagtttccatcaaatctttcatgccgggaagatccggcagggtatccttttttaattcctccacagcctttgtcatggaacatttcccgtcaaagacagcgctttcatccatgatcagggtcttcgtcagaatgtcaccgtataatttaccggtggaaaggatctccgcttttcccctgactttggcatttccagtgagttcaccgcccagggtgaaattttcggcggaaatgttccccttaatcaggcctttttcactgacaaccactttgctgtcagagatgacatctccttcaatcaccccgtccacacgaagcagagtcttgcagtgcagagtccctaaaatccgtgtgccttcaccgatgatcgtatcaatacgttctaccggcttggggacgggaacgggggcaggctccggttcagccgccagggaaggaaattctgtttccggtttcggttcattagaaggttttccaaacatcataatgtatactcctttgcttagttgattaaaataagttgaaaggataaaaagaaaattatccttttatttcaagtacatcttcgggatcgatatagtctccgttccatgtgacacggaattccatatgcggatcgccgttttcattgagagcccctgtcagggccaccgtctgtcccgcggcaacggtttccccggcatttacccggagctccttgttgtaacaataatgggtaatataaccgttcccatggtcaatacgcacggtcagtcccgtctcttcatcttcaccggcaaaaagtacggtaccactttccgcagctatgacatccgtatcctgttccgtgcccaggtccagcccgtaggagtaggcgctgctgccgtctgaagaggcataggggccgtaggtatgcaggataacgcagctgctggtcaatggataaattgcggtaaaggacgcggaaggaacggtctcctcctgtacgtctgaagaggattcctcagtctctgcatcagattcttccgtgggttcggcacttccgttctgggacagaatgttttcttccagctgtgacagctgctccagattggaggtcagttccttttgcagggccttgttcctttcatttgtaacccgcagctgattgccgataaaaaaatagcagaaagcggtgacaataactgcagccccgaaaaaaatgtgtctgaatctgatacgaaaccggcgggagggttttctgttcctcaccggctctgccgttccaggggtgatttcatatgaaataattttctggtattcttccagagcctcccggcgtttttgtttccgttcctgttcgagatcttccatgtgagcagtctcctgtaaaggcatatataagttaaatattctattatatatcggcataaaatgcgggaaaataaatgaataacagattttttgaaattacttattttttatttggatcatccgatatataaattacagtttcaggaaaaaatcacactataaaaaagaagagaatgattgcgtatgtttaagaatgttaagaaaaagacagttattattatgatggtcattatcctgcccgttgcggcagcggcgttggtctgcacccttctggtggtgaaaaaggacgagaaggaaaagccggtgctcccgccggaatattattttgccaaggaggatgagctttcttctgttacggatattgtgggagagaggggatttgaagatctttctccccgggatgaagaatccggttctcaggacgggacagaagaaacagaagtacaggaatccacagaggaagggaatgcggaaacaacagcggcggaagcgtccgtggatgcggataaagagggtctttccgtggaaaagtacagatatattgccggcgagaatacgcccacagatgtgaaggagtatatcgcttacctcacggagaaaaagaatttcattgatctgacacaggaagagggcgaggacgaagaggagccggaggaagagaagaaaacctacacctataagcttgcgggcccttcccatgattccgacgcttatctggagattacaattgaagcggaggatgacagcttcacggtgacggcccttaagaaaggggaagcctggaacagttacgtcacacagctgtgggatgaggaaaagaaaaagaaccggcagaaaaccccggaagagcctaaaagcacaatgcagattgcggaagaaaaggtgcgttccatgagccaggaagctctgaagcttcaggaaccggtggatacctattcctttgtatgtactccgggattaatcaaactggaagacaaagatttctacagagtgtccgcatataaaaagaaggaaaacggtaccatgatctatgaatgcgcctatctggtggaatgcgcttccagaaaggtatcttataaatataattacgtgacggaagaaaccgagcttttagaataaacggagagaaaatccgccttaaatgagaggtaatggaaggtatggacagagaggaagccgggaaaaaggaactgcccaaagaagccgtatttgctctggatattggaacgcggagtattatagggatgctgggctttgtggaaaaggataaattaaggattaccgccgtagagagagccgagcattccaaaagggctatggtggacggacagattgaggatatcagggaagtcgcccgccttgcaggccaggtgaaggaagcgctggaagaaaaaagcggctacaggctggatcatgtatttgtggcggccgcaggacgtgccctgaagacggaaactgcctcctttgaaatggaattcccgggaacggaacgtatcagcgaggaaataatcagccggctggaggccggggccgtgagtgaagcccagaaaaatttcctggaaagggaaaatgaccgggataagcagttctttctggtaggctatacggtttcccaatactatcttgatggctatctgatttccagcttggtggatcacaagggaaagaaaataaaagcagatattgtggcgaccttcctgcccggagaggttgtggaaagtctttactcagccatgaaccaggcaggaatggaagtggcgggcctgactctggagccgattgcggcaataaatgtggcgattccggaaaaactgaggctgttgaacctggttatggtggatatcggggcgggaacctcagatattgctgtctgccgtgacgggaaagtagtgggttataccatggctacgcttgcgggtgacgaaatcacggaaagcattatgaagaagtgcctggtggattttgatacagcggagatgattaaaatacagcttggggataaaaaggaagttgtttttacggatatcctgggatttgaacacagggttcctacggaacagctcctggaaacgctggaggatgccgtatcaaggcttggcagggagattgccgacaggatactggaggtaaacggaggagcgccgtctgcggtattcctggcgggaggcggaagcaggatgaacggactgatggagcagataacaggcagcctcggcctggatgcagcccgcgcttcggtggcgggccgttatttttccatacatgccttttccgatatctgcaatatagaggatcctgagtatgcgacaccgctgggaatcgctgtatccgcagggctgaacctgataaatgacagcttttccgtaaccttgaacgggaagcaggccaagctgttcagcaacggaacccttcatatttcggatctgcttatgatgaacggttatacctatggggatttaatgggccgctccggcaagagtattgtggttacggtggacggtgtacgaaggattttttacggaacgcctgcggagccggcagtattgaagctgaatggagaagaggcgaagatttcggatttggtacatgcgggagatgatattttatttatcccggccgtcaacggaacggatgcacgggcgacggcggcggacatttatgacgaaacgggcagcggtccggaacattccccaatcatgataaacggggaatatgccgggatggacagagtgctgaactatggggatgaaatcattaccgtaaatgccgggaagaaagaaacgccggcggaagctgcggctacggaagccccggcggcggaaaccgttccaaaggaagaggaacagccgcttaccgcagagcctgaacagataattcagtttcagctaaacggcaaaaatataaggcttcccggaaaaccggacggcaccccctattatcttatggatatgcttcagtattccgggctggatatggataatataacagcgccagttgtcctggaggtaaacggcgtcagcgcatccttccaaaggatactgaaggaaaatgatatcatagctatttatgaagaaaagtcaaacaggccttaatcatttatgagatcagccgatatgtaaaggtatagatacagcaaggaggaataatagaatatgaatggaatatatggcaactcactgtctctgatgaccaaagcgcttgacggcttatggaaacggcaggaggttatatccaataatctggcgaatgtggatacgccggggtataaatcacaatatgtaacatttgaagacgctctcagaaaaagtcttgaaaattctcatacaaatggccgtgaaggtattctgaaagccatcgaagttgctcccattgaggtaaaagaagtgacgggccgtacggaacgtcttgatggaaataatgtggatgcgaccgacgaaatggtcgaaatgacacgtgcaacctaccaataccagtatttactaaatgctgtaaaccatgatttatcaaggcttcgcacggtcatcaagggtaactgataaaatttcgcaataaaaattattgtaaaattttcaaaatcctttacaataatgttatatggttgtttaaggtacaagcatatttttaaatttttggtgaagaataagcaggggaaagtaattcaatgatactgaaaaagaaaaagaaagtgacgatgaggggtagaaagatgaataaaaaatgatattgaactgattggaggtctacatgaaaccacataagctaacggattcaatgattcaggactatggaaaaaatctttttgaggaagaaaaaagcaaggctactattgataaatatttaagggatatccggtctttttatgagagccttccggatgataagatagtagacaagaaccgtgtgatacattataaaatgcagctgaccggaacttataaggcgacaagcgtaaattccatgctgactgcggttaacggtattttttcttatttaggatggactgaatgcaaagttaagcttttaaagatacaaaagagttcttttcgaaactctcagcaggacatgtccagagatgattatataaagctggtggaaacggcgaatcagcagggaaaagtcagacttgggatgattatccagacaatctgtgcggcaggcatccgggtgagtgaattgaaatatataacggtagaggctgtgaaaagcagcagagccgtgataaacaataagggaaaaaccagaatcattctgattcctccggaactgcagagtgcattgctgacatactgcgaggagcaggaaatctgctcgggaatgattttctccacgcgcagcgggaaaccattagatagaagcaatatatggcgggaaatgaaaaatctcggcaaaagcgccactgtcatggacgaaaaagtatttccgcataatctgcgtcatttgtttgctgtaacctattacaaaaaagagaaaaatgttgtttatctttccgatgtactgggacacagcagcgtggaaacaacaaggatttatacgagtgtggatgaagccgaacattacaaacatttaaccggtctgggtcttgtcttataactatttcgaggtaaaaaaaacaacataatatgaattatgttgtagataaattcttttcatctattaatttgcgttttctttttttaaattcttttatattataaaggcatattcaaaaaaatgcaacactaatacaaaaaatcgacacatttttctctgttcagtatgcaaatgcgtaaatttctcttccttttttaatgcttattccttaaatggtacataaatttaatgatataaagtttatgtgttacaccacacttaaaatttaatattccatttagtgttgccataagcaaaaaacccgtcctttttcaggacgggttttttttggaattttatgtacgaaaaaaaacaacataattcatattatgttgttttgcgtgttttgaacaaataatggaggagtaatatggataatttttttattgttcccatgaatccggtaagctttcagaatgacttagatttgtcgaaaaatgagaaaatcctggggagcagcggcacagatatgttcagggatatattccagagcatgatatccgacgcggcggcagctgatacggagtacgaaaagcagaaatatcttcttgccacaggacagattgaggacgcccattcggttacgatagccggttcctatgcacagctgacggtggatatgcttgtttctttaagaaataaggcgatggaatcttacaatgagctgatgcgaatgaacgtttaagctgcagtttgtaaaaaatgagaacagagaaacggaacataaaaccatgaatgtaaaagaaattataccaaagattaaagaggcagccgcgaaagtaagcgcaaaaagcagaagagccattcttataggtggagccgcagtacttgttttcgcggtggtttttgctgttctgattaaccgtaaggattatacggtactgtactctgcggtaaatgcagaggaggcgactgaaattgtttcaaaacttcaggaggcaggagtcgcctatcaatataaagataatggcgatgttctcgtggataagaagcaggtggataaggtcagggcacagctcgcgcaggagggatatcccaagagcggcttctcttacggcatttttatcgacaatgcgggcggcatgactacggattcggataagcagacatataagctttatgatctgcagaaccgtatcggagcgacgataggcctgtttgacggggtgaaggatgccaaggtgaccatcgccctgggagaaaaacagagatatgtcctgcaggaggaatccgataatggttccagcgcttccgttgtggtgattatgaaggacggaggttctcccacaagtgaacaggcagctgccatacagcggctggtagccggcagcgtggcaggtatggatatggataaagtttctgtgtttgacggcaacgggctggagataacctcttccctgcagaaggcagaaggcgaagagaacggcagcggggaagaactggcacggatcgtggaaggacagattaccggaaaagtgatgaatcttctgggggccgtttatggcccggaaaatgtcagggtttccgtaaagtgcaggatcaatatggaaaagctgatccgcgagactttgacctacagcactccggataaaatcgacgaaacggataaaacaggtattgtttccaaagaaaatgtcagtgagcagacgagcgacggcgttaccggagtcggaggcgttgcgggagctgagacgaatgcggatattacccagtatgcaggaaatacaggcactgcagggtcgaacagcttttacagttccgaggcaaccagggaatatgtgattaaccaggtgaaagagcagggacaggtacctgcgggagcggtagaggatcttacgatttccgttgcagttaacggaaaggatctcggcgctctgactatgaatcaggtgaaggcgttgattggcaatgcggccggtatcgccgccgaagcacagaacgagaaaatagcggtagtcagcgctcctttctacagaggcgagggcggttccatgcagacagtgaatccgctggaaagcctgatggaggaattgagccggaatccgtttatcctgctgatagcagccgggatcattctgattatcatcctgctggttgttttgattcttgtcatcagatggcgcaggaaaaagaaacggaaaaaagctgcgaatatgcaggaaataccggttgtggctgttatgccggacaacaatcctgaaattaccaaaattcaaaatgagaaggctcagggcctgcgtgaggatatcagagatttcacagaacaaaatcctgaaatatccgcacagctgctgaaaaactggctgaatggaggtggagagaatggcggctgagagctcgaaaaaattaacatctgaacaaaaggccgcggctgttattgtggcgctcggagcggataaagcctctaaagtatacaaatatctcggtgaggaagaagtggaaaagctcactgttgaggtagctaagctcggtcatctggacgcggaacaatcggatgacgctctggatgatttctataaaacatgtctgacacagaaggtagtgacggacggcggcctggagtatgcccgttccgtattggaaaaggcttatggtgaagcaactgcaaatgagctgctgtcaaaggtgaccaagtatctgaaaaaccgttcctttgaatttataaggaaaacggacagcaagaacctgtactccatgctccagcatgaacggccgcagacaatagcgctgatattatcctatacggattccgaacaggcagcgcaggtaattgcagagctgccggaggataagaagataccggttgtggaatgcatagcccgtatggaaagcgcttctccggaagccatcaagctggtggaatcacagctccgtcataagtttgataatattctgaccacggattttaccgttatcggcggcgtggattacattgcggatgtaatgaaccatatggacagaagcaacgagaaagccattttcgacgaaatgggaaaagacgatccggagcttgcagataccatccgcaagaagatgttcgttttcgaggatatcctcaccatggacgaacggtctatacagcgttttatccgcgactgcgatatgaaggatatcgtttatgctcttaagaacgccactgaggagatgtcggatctgttctacaggaacatgtcttcccgtatggcagagacaatacagtccgatctggaaattacagttaatgtaagactccgcgatatcgaagaggcgcagcagcatatcgtgaatacgataaggcgtcttgaggaagcgggcgagctgattataaataagggtggtaaggatgatatcgttgtttaacagtatcaatacggaaaaagaagaatcgaatatcaggctttttgattcctatcaggattttctcgccgcggatccggttccggagcttgaggaggcgccggagagcggagaggaaaaggaggatgaggcggaaagctggggagccctgtttaacatggaatatcagcgtaagatccagcaggccgaagatttgctgaatgcggcccgggaagaagcggaggtcatccgcggggaagcttttgaaaaaggggaaaaagaaggctatgacgcgggttacgaagcgggaagacagcaggcttacgatgattatatggcaacctataacaaggaattgaacagcctgaagcaggagatcgtcaccctggttcaggatatgggaaataaaaaggataaggtcctggagaaatacatcgatgatcttaaggacatatcgctggctgtggccgagaaaataatacacacgagcctgaaatccagcagcgaaatcattaagaggatgatcatctccagtacggaaaaactgaaaaaaacatcctgggtaaagatttatatcggtaaggaagagcccggaatcaatattcagggagatgcggaactgatccatgagctgtctaagctgtccgaaaatgtgaagattgtggtcatggaagaagaatcaggaacctgtatcgttgagcttccgaatgaaattatcgatgtgagcgccggaacacagctggagaacatcaggggaattctggagaacgcgcgtctttaacaggaaaacagggaggaaatatgctgaaaaaactgcccgggctgataacgagttcagaaacagtcagtcatatcggaaaaatcgaaaatatagtgggtatggcaatggaagcctccgggggtgcggggagtataggcgatatcgttatgatttataacgaggatttaaagaaacaggttccggccgaggtggtaggctttcacgaagataagcttcagctgatggcttatgacgacatgagcggaatcggagccggaagctttgtgagaaatacaaggaaaaggctgaagatcccggtgggggaagcccttcggggaagagtgatagattccatgggccagcccatggatgacaaagggcctattgaatcttccagatactactatgtggaaagcccgaagatcaatccgctcagcaggccgagaatcgatgaaaagctggatttcggcattaaggcaattgatggactcaatacgatcggaaaggggcagagaattggcatctttgcaggcagcggtgtgggaaagagtacgcttctgggcatgatagccaagaatgtcaagacagacatcaacgtcattgcccttgtgggagagcgaggccgggaggttcgggagtttatagagaaggatctgggagaggaaggtatgcggcgtaccgtactggtggttgcaacctcagatcagccggccatgctgcgtatgaaatgcccgctggtggcgacaaccattgcggaatatttcaaggatcaggggaaggatgtgcttctcatgatggattccctaaccagattcgcaatggcacagcgtgaaatcgggcttgccacaggagagccgcctgtggcgagaggctacacgccgtccatttatgcagaattccccaagctgcttgagcgcagcggaaattttgaaaatggttccatcaccggtgtatatacggtcctggtggaaggcgatgatacgaacgagccggttgcggatacggtgagaggtattctggacggacatattgtactgacaagaaagcttgccaatgaaggccacttcccggcaatcgatatcggcgccagtatatcccgtcttatgacgagcattgtaccaaaagaacatcaggatgcggcgtccggtatccgcaatatactgagcatttatatgcagaatgaggatttggtttctatcggcgcctacaaagcgggaaccaatcccaagcttgattatgccatctccaaaataaaccaggtaaatgattttttgatgcagaaagtggatgaaaagtttacgtacgaagaaatcattgcggagatggaacgtattttggctaagccgaaggatgcaaaagaaaaataaagggagaatgtacaatcccaaaatgagaggcaggactgaatatgaagaagtttgcttttgctttggataaagtactggattacaaaggccaggtggaaaacagtctccggagtgaatacgcacagaagatggcaaaggtaaaaaaacaggaggtatacatagacagcctgatttcacagttcgcaggctgcaggaacgaattcgaggcgagaaagaagcagggctgtacggttaatctcatggtttcctatgacggatatcttaacagcctgagaaaacagattgaaaaagaaaaacaggttttgacagaactgagaatagacgcagagaaaaaaagagaagaaatggttgcggccaaggtggagacttcatcctttgagaagctgaaagaaaagaaacagctggaatacgataaggaagcggcgaaaaaagaagaacaattcatagatgaattcgtatccaatacagccaattccgccaggagagaagctctggctgcacaggtataaaacgggggtaatcctgcttatgcagattactgatagatattctggaagaaaggaggagagaaaatggtcagcgatgtcagtgcaatgatgaataccgtgagccaggcttcaaaccggccgtcatctgaacgcccgcagcagacagacagttatcatgacatgatgaaaaatatgctgaaggaacagaagcggataaaggaagaaaagaagccgggttcagacagtgacagcacgaaggtgaatgcaaaggaaaaaccggataaagacgaagaaggaaagaaacctgcagagacagacggcagtgctgtatttctgccgccgggaaatggtgaattccaatctgttctctggatgcagcagcctgcggcaatgggagatgcggttcctgaaaccgggcttcagcctgttgacgaaggaaatgttgcggcggttatggctgaaatgcagacagagacagtagatgaagctgcagaaggaccgatggttggaaaccagcctgaaaagccggaaggaaaagaatttttatcggaaccggcctttactgtaccggagaatgacataccggaagaaaaaagcgcagcggttactgtgcctgtgcagatttctgaaggtaaggatgaagatgtttcagacctgcagacagctgtaaatatgcagactgaggttgagaatgtttctgaaaatgagaatctttccgagaagcgggttgatgaaaacgcgcagctgtatgcacaggcagatgtgaaagcagcagatgaccggattgtacagcagggcccgcagacggaaatgcctgttacgcaggaaacgcccgaaagtccggaagagatgtttcagacgctgccgaaggaaattttcacccgtatatctgccggtgaaaaagaatttaccgtacagctggaaccggaaaatctggggaagctgatgattaaggcttcttatgcagacggcaaagcaagtatatccattatctgtaccaatgaaaagacaatggagcttctttccgggcatgccagagaaatcggcggcattatggaaagcaatctgggaacacccactacggtgctgctggataaaacggagccggattacttggaacagggacaggacggacaaaacggccggcaggaaaatgcaagggacgacgaaggcagagataagaaagagcagaagaaaaacggcctggatttcctgcaccagctcaggttgggattggtctgacaagaaaacggcagcacagatataaaaaggagaatgaaaaatgccgggtgtacaactacgtacgaatgaatcccaggatttgtcgtcgaactggtcttcgccaaaagcgtcggcgggaaatatgggactttcgattgatgatttttataagatactggcagcccagttaagatatcaggatgccgacaatccgatggatacaagtgaaatgatgtctcagatggtgcagacacagatgattgctaccatcaaccagatgaatcagatttcagttataacctatgcttcttccatgataggaaaagaagtaacggtagcacttttggataaagatggctggcctacaggtgaatttaaaacaggagtggtgtcaggagcttctatttatgattacccgccggttctttatgtagacggaagtggttatcaggtttctcaggtgactatacttgggaacaggaattcagcgcaggctccgcaagatcctgatgatcctaatgatggggatgacgatggttccaatcctggagtggaagggcctggagacaacgatggagcacctccggtagacggcggggaagatgggaacggaacacccccggtagacggtggagaagatgaaaattcaaatccgccaactggaaatgaaggaaatagcgaaccataggagtggtgagatggatggattacattcagtttccggtataggggagctgcggcttaagcatgatgcacagctggtacaaaaggatccgtcttcttccttcgcggatatgctgcgggataggctgaaccaggaaggagcggtcagattttccagacacgcggcggaaagaattgcgcagaggggagccgatatctcggaaggacttcttgaaaacctgaacaaagctgtggagacagcaagggacaaaggagccagggataccgtaattatcagcagggatgatgtgtttatagtgaacattccccataacgtggtagtgacgatggtaccctatcaggaaatgaaagagaacatttttactaatattgacagcgctgttttaatttaacgggaccggttgcggaggttaatccggatatcggaagtatatccggaatacagcagctgtattcagaaaaagaaagggagaacataaagaatggttggatcaatgtttgccgcgatatcaggtttgaaatcgcatcagaccaaaatggatgttataggtaataatattgcgaatgtaaatacgtggggatacaaagcccagtcggcgaactttatggacgctacataccgtactacgattgcaggatcagcaggatcggcaactgtcggaggcgtgaactcttcacagattggatacggagccaatgtaggatccgttactgttaattattctaccggaaacagaaaccctaccggatggggcggggactgtatgatcgacggacccggcttctttattgtcagtgcttcgccgcttgccaatccgattccaaatggtactcctctgacgagcaatgatggaattatgctttccagagtagggattctggcattcgacagtgaaggtaatctggtggatgaccagggaagctttgttctgggttatggactggatggaaacggagcggtcaatactggtctggatatgattaaagccaaaaatggtcagacttatacctctatttctgttcagacggatggaacgatcactgctgtagtagaaaaggataccaccggaacgaataatcctggtgatgtggtaacactgggaaggctgggtgtggcttctgtcaacaacccgagcggtctggataaaacccagggatattattacaaaataggccccaatgcaggcgacgtatcccatggagaatccaacgcggcaacaggaaaaatcctcagcggttatctggaaatgtccaatacagacctttccacggaaatggccaacatgatcaccacacagcgtggtttccaggccaataccaaaatcattaccgtaacagatcagatgctggaagaacttgtgaatatgaaacgataacagtgagcggaggggtccgtcccctccgcagctagagtaaggggaagacgaagtgattgagttaacaaaaattaacggtgagctaatcgtagtgaacagccggcttatagaatacatcgttgccattcctgaaacaaaaatcattatgaataacggcagataccatctggtaatggagcccccgcaggagattatcagaaaagtaatagcgtttgagcagaaggtggctgagggctgggtaaaaatgaactgttgcatggccggggaatacattgctaacacaccggaggaagaggagaagggggaggattagcatatggacatttctacgattctcggcattatccttggctttgctgtaataatttatggaatcggaatggaatctctgggtaacttcatagatacgtcgagtatttttattactgtaggcggaaccttttgtgcactgatggcatccttccctctgaaacagctggtcaaaataggcgttcatatgaaaattgtgcttttcggtaataagtttaaaccggaggaagcgataaataagctggtggatctcgcacagctggcaagaaaaaatggtctgctggcgctggaggaacaggccggagacataaaagatccgttttttaagcggggagtgcttcttgtggtggatgcgatggaagcagagaaagtacggagtctgttggaggaagagattgccgccatggatcagcggcatgattccgatgttgcattttatgagaagggaagtatttatgcccctgcattcggtatgattggaaccctggtagggctgataaatatgctgaaggaaatgaaccttgatgaaggctcctcctccagccttggactgagtatggcgacagccctggtaactaccttctatggctgccttttggcaaatctgatatttcagccgatagccaaaaagcttcgtatcagaaatgatgatgaaatactttaccgtcagattattgtggaaggcgtagtggggatacagtgcggggataaccccaagagccttaaggaaaagctggtttccaccttaagccagaagcagcagaacaggatgttgaatgacgctaacgccaaaaaaggcggcaggaacagagaaaagagcgcggaagaataaaagccggcagtttgtttcaggcggcaggtaaaggattataacaggtgcttatatgaaaaaaagaaaaaaaaattcagaacagggcgattggcttaacacatatgctgatatggtaacgctgcttctgtgcttctttgttctgttatacagtatttcatcggttgaccaggataaatggaagaattttgtattgagtatcaatccgcaggcggctgaagcgcttcaggagccgagagcagacggtgcatttcaggaaggtgttatggatgaataccctgaaggcgatgcggatgcatttgaggaaatgttccgggcgcttatcgaagcggcaaaccagcttggcatagaaaatcaggtaagcataacccagggcgatggttatacgtttatatcctttaaggataaggtgttttttgacggagacagtccggtgctgaaggaagagggcaaaactgttctggatgcatttgcggaagcgattgctcctgctgcggacagtgtaaaacagatagaggtactggggcatacatcccagggtgatccggaaattccgaatgaagtgatgacagacagggtgctgtcggcggaacggtcagcacagattgtagcttatttgcagggaaaagacataatagagccggctaaattagtgagtatggcttttggacagttcagacctatagataccttccagacatcagaaggaagggcacataacagaagagcggaaatcctgataacgaaggacggaacggtggaacgcagcctgagctattattacgaacaggtttacgggagcggaacctttgaagaagggatggatgccctgaaagaggaaggcggggatacggatgcgggtgacagcgcagacgataaacaggagccttcagagggaaagaacggggaataaaaatacaggagtaagcacatggctgaagtattatcacaaagtcagatagacgcattattgaattccatggtaagcggcggggaagacgcagtggaaacagttcagaaggaagaacaggcctaccgctattatgatttcaatagtccgaaaaagtttaccaaggacagattaaagctgctgaagggaatttatgataattattgtcgtattgcaacttcccagataaacagcttattccgggtaaacagcgaggtagaagtggtaacggttgaggaacagagatattacgaattcagcaatgcgctgggggataacgatatattgacgttggttgatatcaagttcgcggacaataccagcaaatatcctcctctgctgattcatatcagccagccgttgatggtcaatatgattgaccggatgctgggaggcaacgcggaggatatgagcatagacacttcgtacgtatatacggagcttgagatgcctttataccgtaagattatcgaatatcttacgatgatactgcgggatgcatggagcagttatttgaagcttcagcccaaggtggagcgtatcgaggaaaatcccagccttttccaggatatcagcctggacgaaaccgttgtaattattttattggatgccaagctgcagggggtaacaggaaaggtaagcttttgtataccggaaaccctgctggcgggagtatttgacgtaattgataacagaaagcgcacagaggatgaatacgagaacgcgcttccggatgtccatcaggttatcatgaacaaaataaaggattccattcttaccgtaaaggcagatttgggcgaggcggagcttgatctggaggatatttataacctgcaggtcggagatgtaatcgatttgaacaagcctcatgattccgaagttgttttgtatgtggaagagcagccctggtttgtaggaaagcttggagtgagcaataaaaacgtggctgtaaaaatcgacagccgtcttgataaagcagaaaatgcaaaaaatgaaatacaagcagatgattttacacctgctatgtagatagatgttaaaaaagtgaggtatacagaaatggcaaagattctggtagttgatgatgcggcatttatgagaatgatggtaaaggatgctttatcgaaaggcggatatactgatgtatatgaggctgaagatggagcgagggcagtggaagaatacgaaaaactgagtccggatctggtgatcatggatattaccatgcctaatatggatggacttcaggccctgaaaaaaattaaagaaatcaatccgaatgccacagtggttatgtgttccgccatgggacaggagagtatggtaattgaagcaattaaatcgggtgcgaaggattttatcgtaaaaccctttaaagcggacaggattctgaagacagtttccagtatcgtggatgcataaaggaggttgagtatgtcttttatcaattcattaaatatcagcgcctccggcatgtcggcccagaaactgcgtcttgatgtggcggcggaaaacattgccaaccaggagacgaccaggacggaaaacgggggaccttacagaagaaaaatggtagtgctccaggcggcggaggacaacagcttccgcaaagccatggattttgcttcttcacaggccaggcccgccggtgtcagggcggtacagatcgctgatgacgcaacacagctcaatcctgtttatgatccgacacatccggatgcggatgcaaatggctatgtccagatgccgaatgtggatttggtgaaggagaccatagacagcatgtccgcaaccagatcctatgatgcaaatattacggccttcaatgctatgaagctgatgatgcagaaagcattggaaataggaaagtaagcagataactttggccagaaagagagattggaaagatgggtgcgaatagatttagtccggtagagatagatgcgataggcgagatcctgaatataagccttggagcttctgcaactgccgcatcaacaatgcttgatgcgagagttgatattacgactccggtagtacgggtggaaagcagagacgaattcagctttaaaaatctggagccggcagtcggagtggaaataacgtatgtagatgggcttaccggggataacgtcatgcttttgaaaaggcaggacgtgaaggccattgtggaaatgctgatgggtatggagatagcggatgaggatttcgaattaaacgaaatgaatatcagcgctatctgcgaagttatgaaccagatgatgggagcttcggccaccgctttgtcagagcttctgggaaagcctgtgaatatttctacccccagatcatttgaaattacaagtgacgaacagttcaaggagaaatatttcactgaaggaaaccataatatggtggttatcagttttcacctgaaaatagcaggtaagctggaaagtgattttttaaacctgatgccgatcaggttggcaaaggaactggtattaggatttttcccggaaggcttcgatgggatcgaaggagccggggaagaacagacaatgcaggaagaaataccggcagaaaagcctgtgtacgaagcacagccggaagcagctccggatactttcggatttgtaatggatcaaaccgttccggatactacttccatggatacttctttaatggatacgcctgccggacaaatgcaggcatcgccggaagaaagggagattcccatgcaggaacagtcagcagtcccgcctgttacgggacaggatacagcacagcaaatgtatatgcagccgcagcagactgcagcagtccagatggattccgcggccctttccaaggagcttttggaaatgcagaggatacagatggagcttatggagcagatgcgccagatgcaggcagagcgcatggaaagaaaaccgagacagatccgtgtacattcttccgttcagccgtccctgcatgatgaaagcgccggcgaaggtgatccggacagcaatctggatctgattatgaatgttcccgtggaagtatctgttgaaatgggcagaacgaagaagctggttaaggacattctggaactgaataagggttctcttgttgttttggataagcttgcaggagaacaggtagatctgttcgtaaacggacagtgcattgccaagggtgatgttgtagtagtggatgataatttcggcatccggatcacacagatactgagtgaggatattccggttgcataaggataaagaatatgtttgaagggttttttactgctgcgggaacgctgattttagtagttggtattttagtactttgctattttacaacacggaagctgggaagaatgcagcccggagggggaggcggcagatatatcaggcttttggagcggatagtcataggacaggataaaacgatagcgctcgttcaggcaggagataaatacctgttgctgggagttgcatcatcccagataaccgtactgatggaattgaataaggaacagttaacagagcttgaagtaagccagggacagacggcggatttcaaaagcatcttggaaatgataaaggatagaaagaagtagctatatggatgaaaattcactgataagtatcaacggcaatgggatgcctaccttacaaatattgttaatgatgacaatcatctcattgctgccatcgattgtggtcatgatgacttcctttatgagaatcgtcatcatcctgtccttcacgagaagtgcgattggcgttcagcagactcctcccaatatggtcctcatagggcttgcgctgtttcttaccttatttattatgaatccggtgctgaaagaaatcaatgaagaagcttaccagccgtatctggcggaacaaataacgcaggaggaggccctggaacgaatgcaggtgcccctgaaggaattcatgcttaagcagacggatgtaagctccctggaattatttaacgagatggcaggtaatgagaaggtggaagagcccagggatttacctatgacggtagtgattccatcctttatgacaagtgaactgaagagagggtttatggcaggattttttatttatattcccttcctgctgattgatattgtggtttccagcacgctgatgtccatgggtatgatcatgctcccgccggccacaattgcactgccctttaagcttcttttgtttgttacggtaaatggctgggagctgttattttcagttatagtaaagagttttaattactgagagaggttattggaatgactaacggtgaagtagcggatttgatgtataaggtttttattatggcgctgcagcttggaggacctgtcctggttgtcagtatggcagtgggtatcattatatccatccttcaggccgccacccagatacacgagcagacgctgacgtttgttccaaaacttctggtgatagcaatcatcctggtttttaccggatcgaatatgcttcagtccctgcaggattttacaaaagaagtatttgcattgattacggcaatatagtgcgggagggaaagaatgaccggggaagttacggatcagattatacttttctccatgattttaatgagaatgtcgggatttgtgctgcttaatcctgttttgggaagaagaggaataccgggcatgataaaagccggtatgattatggttcttacgattatgatatacccgatttccgaaatcacagggagggttcctgtgatggcgctggagttggtgctgtgtcttttgaaggagtttgcaatcggatatcttatgggcttcataatgcagctgtttgattatgtggtgacctttgcaggctctctgatagattttcatatgggtttgtcaatggcgagtgtttatgatcccgcaagcggggctcaggttgccctgacgggttctgttctcaatatttattatatgcttttgttttttgtggcggacggtcatctggctttgatgaaaattcttgttacatcagccgatgtggtcccttatgggcagatagcattcggaccaaatgtctggaatgcgatgctggtaattttcacagaatgtacggtgcttgccgttaaactggcgtttccgctgatagctattgagttcctgacggaaatgggaatcgggattctgatgaaaattgttccccagatgaatttgtttgttctcaatattcagataaaagtgctgatgggattagcagttattatcttttttatttctccgataggagattactttggccgtctgatcacacagatgatggatacgatgcaggaaatattaagactgacggcaggataaaggatgtgattaaatggcggccgattctaaaactgaaaaagcgacacccaaaagacgccgtgacgagcgtaaaaagggaaatgtattcatgagcaatgatgtcatcgttgttctggggctggtgggaatattttgtatgctcaggctttattttcccattcttatcgacacagtccgcgattacatggtccgtacgtttgaggaagtggcggtacagactgagtttacgcaggacagtttgaagagtttttcctataacttctttataacgggtatgaaggcgggattcccgctgctcatagtttctgctgttcttcctatccttgcggtgggaatccagacgaagttcctttttacaacgaaacatatttcacccaaattcaaccggctgaatccgctgcagggaattaagaagcttttttcactgcgaagcgtcatcgagttgttaaagagtattctgaagaccattgtattggtgattattctctataacatactgaaatcagactttctgcaaatcacgaaaacaatggatatggatttggcgatatcgtccgggttcatgctgaacatggtttttcagatgatcatgaaggtaatcctcgttttcactgtcatcgccggtttcgattttatgtatcagaaatgggaatacgaaaaaggaattaagatgactaagcaggaaatcaaagaagaatacaaagagactgagggtaatccggaaataaaaggcaaaataaagagtctgcagcggcaggcggcacagaaaagaatgatgcaggcagtgcctaccgcggatgttattgtccgtaaccccacacattttgctgtggccctgaaatatgacatggaaaaggatacggcgccgatagtggtggcgaaggggcaggatgaactggctttccgtattattgccgtcggtgaagaaaacggggttgcgattgtggaaaacaggcctttggcgagagcattgtatgcagaatgcaaattagacaggcagatacctgcacaatattatggcgctgtggcagagattcttatctatgtctttagagcgaatcagaagtggagtagtaacaggtaatgaagaaactaacaaattatgcagtatctttgttcgtcatcgtaattgtactgctgttgattataccgcttagtccatttttactggatgtttttatcgttataaatatttccatttccctgattattctgcttgtcagcatgaatatacgggaaccgctggaattttccatattcccctccctgctgctgataacgaccttgttccggctgggcatcaatgtttcttctacaagaaatattctcatgaaccaggggcaggcaggccaggtcattaagtccttcggtactttcgtactgcagggaaatgccattgtcggttttattattttctttatcatcgttctggtgcagttcattgttataacaaagggcgcggaacgtgtatcggaagtggcggcgaggtttacattggatgccatgccgggaaaacagatggcaattgatgcggatttaagctcaggccttattgatgaaacagcggcgcgtacgcgcagggaaaaaatccagagagaagctgatttttacggcgctatggatggtgcaaccaagattgttaagggtgactccatcatgtcaatcatcattaccgcaatcaaccttatcggcggtgtggcgatgggcatggtgatgtcggatatgccatttaccgaggtcctgtccgtttattctattgcgacaatcggtgacggactggtatcccagatccccgctctgctgatttccacggcgacgggcatgatcgttacgagagctgtctccgaaggaagcctgaacgatgatgtatccaagcagttcaccgcacagccgcaggcaattatgatgaccggcggtatcatgctcgtactgcttctggtgccgggaatgcccaagttccagatgcttttgctgggcggcgggctgatcgctgccgggtacttcctcaacaggaagacgaaagaggcggcacagcaggaagcagctgcagctgcaggtgcggtcgttgaagaacagaagaagactgccgacgaaggagaatatttcaaggatatcaacaatgtgtattccatgataggagtggatcctatcgaaatggaattcggctacagcctgataccgcttgtggatgaatcaagcgggggcaaaatgataaaccgtatcgttattttccgaagacagtacgcccaggaaatgggtgtggtcataccttccatcagtcttcgggacagcagcagcctcaataccaaccaatatgtgatcaagatcaagggggaagaggttgccggaggggaaatcctggtggattactatcttgcgctggagcctgccgaaccgacaggagaggttgacggcatagaaacaattgaaccggcctatggtatccccagtaagtggatacttcccgaaaataaggaaatggccgaaatatatggctacacagttattgatccgctgtctgttatgattacacatttgtctgagacaatcaaacagcatgcctatgaagtgatcaacaggcaggaagtgatgcatctgcttgagaacgtccgtaaaacgaccccggaacttgtggatgaagtattcccgggaattataagttacggcaacttccagaaaatattagtcaatctggtaaaagaaggaattcctgtaaaagatatggaaacaattctggaaacagtagctgatgtgggagcgacggtaaaggacattacacagattacagaaagtatccgtatagctctgaaacgtacaattacaagaaaattctgtcagggcggacagatgcgtgtccttacgttggatgctgaactggaaaaggtgatagttacaagcctgacaaaaggagagcagggagtatatacggctttgagtcccgatacgatgcagagccttatttcccaggtaggtgaaggaattaagaaattcaatgatctctcccaggatgtggtaatactcaccagccaggtaatcaggatatatttgtacagactgttggaacagttttatcccaacgtttatgtcctttcctttcaggaaatagcgaacaatgtacagattcagtcaatcggaaatattgcattataactgctggagggaaagatggtgctagaagttaaaccaaagaaaacagactacggaaaaatgacagatgaagagctgtgggaagaatatgaaaaaaaaggcggcctggaactgaaacaggagctggctctcagatacatttatattgtccgtaatgtggcaatacagatgagagacgtttatatgagctttgcccagcttgacgacattattaatgaaggcgtaatcgtggtgatgagcgcgattgacaagtacgatcttcatcttaatgtgaagtttgaaacctttgtatccaaacggatccggggaatgataatcgatatggcccggaagcaggattgggtaccgcgcacggtgagaaagaatgcaagggaaatcgatgaagccaccatgcatttatacggaaaaaccgggagaatgcctacggcacaggaaaccgcagaatatctgaatatgcctcttgataagtatgagaaggttctcagcaaggcaaatcttttttacattttgtctctggatatgctgatggaggaaaaggcggaaaacagacagacagtccagatcccgtcacataattacagggaacagccggaggaatgctatctgggagatgaatttaaggggattctggccgatggaatcagaagcctgaaggaaaacgaacagacggttatctctctttattataaagaggaattgagtgcaagagatattgccaaggttcttgcgtaagtgaaccgaggatttcgcagatccattccagtgcaatacgcaagttgaaaacatatatagaaaacagagtgaaataaagaaagtgagggcgtgttatgttccagggattctataacctcggctcagaaatgctgtgccagaccaggaatatgaatgttatcagcaataacatggcaaatgtggcgacggccggattcaaaagagatgatttccaggcatcggctttccgcgaagtgatgatgtccagatatcagggaagcagtgatacctccccggcggcgctggggaatatggcgatggtccgttcagcggatacgactgtgacagactactcccaggggatgttcagggagacggaaaacacgttggattttgcgctgacgactccgggatttttctgtgtgcagacagagggagggaccgtttatacaagaaatggttcttttgcacttgatgaggaaggatatctcaccctacccacagtagggcgggtattgggacagaacggacccattcagcttcccacggatgatattatttcggattccagggggaatatattcagtgcggacggacagaccctgtatgggacgctttccgtagtggactttcagaattatgacgaacagcttgtaaagacaacgggaggcgcgtttaccgctcaggatgcggggactcccgtggatgctgatgtgaagtggaaagcgacggaagggtccaatgtgaatcccatggacgagatgaccgcgatgatgagcggacagcgttccctgcagagcgccgcgcagatcttgaaaatgtatgatcatctgatggataaaacggtaacgcagctggggccggcataaacggcagaggaataaaaaataagtttgaaatgtgtgcctgagggcacagatgggagcggaaaatgaatatgtcattttacacggcggcgctgggagctgccggtcagcaggaaaaaatgaatgtaatcgccaataacattgcaaatgtgaatacggatggattccggagcaagaacgcggtgttttcggatttgatgtactataacatgcgcgatgagcagggggcggataccagggtaaaggcgggaagcggcatagccatggggcgtacggatacggatttcagcgaatcatcaatggctcccacaggaggaaataccgatttcgcaatttccggaaggggctttttcatgcttcaggatcccaatacacaggctgtttcttattcaagaaacgggaaattcaatatgtctctgagagcggacggattttaccttgttaatgacaatggaaaactggtgctggatgaaaaccggaacccaatccggctggatgaagaaggaattgtgggcggagcccggcccggtatttatacgttccctgtgcagcaggggatgctgaatacgggaaacaatgaattgacggcaacggaaaagaacggtgagcctgtgctttcggcggatgcagaactgcgtcagggttatctggagcagtccaatgtaaatcttgccgatgaaatgagtaaaacgattgagtgctccagagcttactcctatgtgcttaaaatgatccagacttctgatgaaatagagcaggtaataaacagcctgcggtaagggtggtaggaaatgaacagctatgatgatatgaactatatggaaatggatgttataaaggaggtgggaagtatcggaaccgggaacgcggcctccgccttgtcgggaatgctgggtacaagggtccgtatggtgcttcctcaggtgaatgtgctggattttaacgaggcattgaacgccataggaaatccggaaaccatcgttgccgcggttatggctcagatgagcctggaaatcaatggcatcatgctatttattctgaagccggatctggtaaatgatatagtaggacgccttctgggacatcatattgatgattattcccagttggatcaaatggatatatccgcattaaatgaagtgggcaatattatgatttcctcctatgtgaatgcattgtcgggacttgcaggcgtggatgtggcgctgtcggtgccggagatatccgtgaatatgctggggggaatactgagcgtgccgatgattgagtttggttatcagacagataagctcatgatcatccgcggaaaattcattattgatgaaaaggaacttgacagtgacctgcttatgcttccggacattgtctctttaaactatcttatgaaaaagctggtacataataatggataaagaaatcaaggttggtattgcagatatgaaggttgcccgagtgcagggccttttgatcacatatgcgttagggtcgtgcatcggagtgactctttatgatccggtgattaagctgggcggccttttgcatattatgctcccctccgcagaaaatgtgtccggggataatgtatataaattcgctgactcagggatccgggaaatgctgcggaaaatgcaggccttcgggggaatgaaagtcagatatgtctgtaaaatagcaggcggtgcaaaaatgtttgaaatgcagggaagtttgggaaatataggacaaaggaatatacagagtgtgcagaatgtgctgcgccaggaaggcatccgcattgtcaggcaggatgtgggcgccaattatgcgaggacactttccatggatgtggaaacaggaactgtaaaagtcaggtcatacggcaggcctgagatcatcttgtaaggcaggtaagggagggcaaatgaaatggataaatgtgtagtaagacaggcaataaaggaagtcagcactcagaatattatcggatatgaaattctgttccagacaaacggagacgatttgtactcgaagacggaaaattcagcggcagataaaatgattaatttcctgatgcagaacagcggcaagatcttttctgataagccgacgtttatgacatttaccccttctttattgttcaggaatctgccgaaaatgtttgggaaggaaacactggtaattcagatcgaagacaatctgatagtacatcccctggcgcttcccatgattaagaaatataaagcggaaggatatctttttgccatcaatgatttccagttttcgcccaagtacttcggtatgctggaatacaccgattatatcaggatatcggtgagcggtaaggatgagaaagaaaggacttccctggacaatgtggtgaaaatggcccaggccttcggcaaaaaatgtattgccacaggagtgaacggaaaagaggaatacgaactggctgccgctcttaacgtggaatatatggaaggcaactacattgcggaaacactgatgacaaaagcgaacaaaatagattatctgcagggaaatttcttccagctggtcggcgccatatccaaggatgagccggatatggatgagctggaagaaatcatcagcagagatgcgggattgacctatgcactgctgaaaatggtgaattccgcatattttgccctgagaaaaaggacggcttccgtccgtcaggccattgtgacaatggggctcggacagctgcgggaatgggtttatatgctcagcatagatgaagaagatcctacaggaagttctgcggaaatactgaagatgtccttcctgagggccaaatttgcccaggagcttacgggactcattcataaacctgattttcctatcaataaatttgaggcctatatgatgggaatgttctccaatctggaatatatggtggacgctacaatggaagaaatcctggaagagattccggtaaaggatgaggtaaagaaggcactcatttcttatgaaggagatgccggaaagctaatgcttctgatattagcctatgaaaaggccgactggaaggaaagcaagaagctggctggtgagctgggaatcgatgcgactacgctggcacagatttatatggactgtatccagaatgtaaatgagatatggcaggcgcttaccacggattttaagcgtaaagaagacagcgtggaaagggaggaatagctttggcagttaatattgtgctgaccaatcaaaagggaggcgtgggaaaaacaacaacggccgcttccctcgcggcgggacttgtcatggaaggcaaaagggtgctggcgctggatctggatccccaggggaatctgggtttcagcctcggcttaaatgcggatgccgaggggacgatctatgatttaatgaaaggcaatgtagatatccgggagattatctgtcccacggagtatggggacatcattccctcggatatcactctcagcgcgggtgtgaaagagttttatgaaaagggaagagagtcccttttaaaggaagcgctttctgacatcggagacgaatatgattatattattatcgatacaccgccggccctgaatatactgacaataaatgcctatgtggcctcggactatatcattgttcccatgtcttccgaaatcctgagtctggtcggcctgacacagctgaaggaaaccgtagattcagtacggttatccctgaatccgcagattcgtatcctggggatcctgctgaccaaattcaacagcaggacacggctggcaaatgaagtaaaggaaatggcggaaagcgtggcattgcagatggatacagccttgtttgacaataaaataagaaacagtgtatccgtatcggagatgcccgcacatggaatgagtatttttaagtacgcaccccgttccaagccggcggaggattatctctgttttgtaagggaagttattgagagaatcggataaggggggaaggaatggcaaagaaaacaaataagacagagcatgtgctcagcctgctgtccggaacagatgcagctgttgaaaaagatgaaaagaaagaaacagaaaaaaaaggaacagggcaggaaaacgatacggcagtacaggaaaatcccgcagtgaaccgccggggtaatgtgcatgtggtattggcaaacgggggagaaggagatccggttgcggaaatcgtgaaagaaaagctgcaggaggaactggataattatccgctgccttctgaggaaggcagttccacggaaacggagactccttcggaagaaccggcggcggaggctgccccgggatctgatgaagcccggggaaaacagacttccggagaggcgcagcttcctgaaaaagaagagctttcacaaaaagaggagcagtccccaaaagagcagaagcctgaagctatggatggctttgtattctataatattatggaatcgattgtgcaggaaaaggccattaagtatatgaaacagtttggaaactgtacatgcaaaaggtgtgaagccgatacgattgcattggccttaagtaaattacctcccaaatatgtagtggcaaagacggattccatatcgccgctgctcaatttttatgaagatcattatgcgggccagattatcgtggagatcacgaaagcctgtatcgttgtaaataaaaatccaagacataacagataaggaaaaatttatttcctgtttacggaaaaagtcggtatggtatattaaattcattttgtttctgtcgataatgaatgtagataccattgatattttagaagaaaaggggtgtacatatggcttctataggcggattaagcagcaatgcaagtacaaacagtgcatcttccctcagaggttacggcgggctggccagcgggctggaccgtgacagtctgatcgaaagcatgacctatgcaaccacatcgaagatacagaaacagcagcaggcgaagcagaaaataacatggacacaggaggctatgagaggaattacggataagctttataatttctctcagagttttatttcttatacctctcccaagagtctgctcagcactaagcttttcagttcgaatcagatcaccgcactgggagaaaacagtaaatacatcggagtgtccggcagttcttctctggcgaaatccatgtccatcgcaggcgtgaagcagatggcatcggatgcaaaatgcaatttcacaggggctgcatcggatcagaagctggccagcggcgggattgatgaggatttatccacactgaatgattacagtaccgtagcaggaacaagctttactgttaaatatggctccaaatattacagtgtcagccttccggagaatagtgaagattataaatatgatacgctgagcgacgtggccgcatccataaacaaggcaatgggggagatctctgtcggtgacggcaagactctggcggatgccatggctgtttccgaggatggaagcaggcttacgtttaccaataaggataccgcgggaaatgcgcttgaactgaccggcagcagcgacaatcttcttggcaatctgggatttcagtttggacaggataataagggcattgaaatcacttcatccggtgtccgcggttccagcaatgcaaagctcacggaacagaagtcggttgcggatcaaatcggaggaaagcagatttgctttacctataatggaaaaacagagtggattcaactggcaagcgctgcagatttgaaggatcccacaaaaggaaataacgatttggattatctggtttccgatctgcaggcgaagctggacaaagcgttcggtgcaggcagaatcaatgttaaggcggattccacagctactccgggacaaagcagcctgtcttttaaaacgactgttccgaccaataacaacagtattgtagaggataaaagctccgtgctttccctggcagccggggaaagaggattgctgggacagtacggcgccttaaccggactttccgcaggagattccaacagactgaatctggaaagcagctggacgaaatcaggtctgaaacatatggaagggatgacggatgcacaaatcgccgcgctgccggatgaggatactctgaaaataaacggaacggaaatcaaaatcaaaaagggcatgagcctgacggatattatggatgccattaacgcttccgatgcgggcgtgaaagccagttacctggcggaaggagatcgttttgtgctcacttccacagaaaacggagcgagcggcaagattgaaatagacagtgatcagggaatagaccagcttctgtttggtgtaaaaggaacggattacgaggtacaggaaggaaaagacgccattattgcggtgaaatatgcaggttccgatacgccggtagaggtgacgagaggaagcaacagctttaatctgaatggccttactgtgaccgttaaaggggaattcggatataatagcggggtgttggatcccgctgccgaagcgataaccttcgacgtaactatgaatacggaaccggcggtaaccgcagtaaaggaaatggttgacgcgttcaatgaaatcgtgaagctggtcaatgacgaggtttccaccaagccgaaccgtaaatatgatcccctcaccgctgagcaggaagacgagatgtcggaaagccagatcaatgcgtggaatgaaaaagccaaggcggggatgctttttaatgacagtgatatccgcgggctggctgacgcgcttcgtacgattataagcggcgatgcctcaaatatgcagaaaatgggcctgtcggtatccaccgattattcggataacggaaagcttgtatttgatgaagaagccttcaagaaggctttggaaacggatccggatggggtgataaatgcctttacccgccctgctgagaaagatgccaatggaaatgtgacggatgccggaggcgtgatggtccgccttcagaccataatggagaagtatgcatccacaaccggtgctacgaaaggaatccttattgaacgggccggttccaagtatgcgcctacatcgatactcaccaattccatgcagaaacaattggatgcaatagataaagagatcgaccggctgacagataagctgtcggtagaacaggatcgctacatttcccagttcaccaaccttgaaagactgatttctcaaatgaacagtcagagcagctggctggcttctgctttcggcggcgcataaaaagggctattttgggaatagagagaaaaggaatattgaaatgaataaaaacggatatcagcaatataaggagcagtcggtaaataccatgacaaaaggggaaatgctgttgctgctatatgacgaattactgaaacggcttatgcgggccgagcttgcccttggcaaggaggactatgagacttttaccaattcggtaatacgctgcagggatattgtctgttatcttcgtgattgtctggatcctcaatacgctatcagcagtgagttgagaaggatgtatgagtttttcctctatgagttcggccgtctggaggccggcaggaataaagaaattattcaggaagtgcggccactggtaacggagctccgggaagctttccaggaagcggataagatagctcagtattaaaagatgggattgcataacatgaacgaagaattgttaatggaagttttaagccagagcaggaaaaaatatggctgcgtgagtgaaataggcagaatgacaaaagagctggcagaggccctgtcgagaaatgacaaggtctccgcccagcttctgctggagatgcgcggcgaagaaatggctaaagcggatacctgtgaaaagaatatccggcttttagtggaagaagcaggcattcaagacagagaacggcttgaatgccttctttacagaaaaggggaatatgggaagcccgaagaggaaagcggacaggaagccatccttgtgaaacagattaatgatgtgaatacaaaaatacgggatattctcaaaaacgccattacggttgacaaggttgtcagcaaaaggatggcaggtgaagagtctttttataaggaataaaataattccggattctatgattcctgttccatttttgcagaggcggatatgacccacaccggtccgccggccgtggatcttgatgaaagctcatccagcagaagctcaggcggccagctgacagcgttgttggaaggattgaacggatcagccacggtaatgtttccgttatcggttacgccggtcagtatgataaaatgtcctctctgtgtaaaatggccgggacccatcagcagtacaatcagcttattataatataacggcagctgaagggcttccggggaacggatggaaagactttcggctttcaggccgaaggctatggcgccttccggtatcagattatgcctgcttccgcctccggcgctccaatatccgtgttctgctgcccagtcggccatatcaacaggagtgacagtttgggaagtcagattggaaaccagcatggcgaggacggtagggccgcatccatatttggaaaggggatcccttcctccgtacaggtaatcttcccattcaggatctgtctggctgtagtaaatgaaagacgactggggcgataaatacagagacgagagtatcccggatgatttggtactgtttttttccggcttgaagcagctttccgcatttgaagaaaatatgggaaaggcatttacctttattgctgcgaacaggaaacatgcagctattatgaatagaaacagaaggattttttttctcataagaaacctcttgacccgtaggtgtatattttaagatattgtcttttcagataatagattatacctatattatcggttgaaatcccaaaataataagaaaattgcctccgggcaaaatggaaggtaatatggcagaaatacgttttgtaaatgtgagtaaagtatatgatgaagatataattgcactggagcgtgcttcatttgatatcggtcagggggagttcctgttttttataggaagaaacggagcggggaaaagcacggctttaaagctgctgaccggtcaggagacggttaccggcggagaagtttatatgaacggcagttcggtgagcgcgctcaataaaaaacagctgccctacttcagaagacagttcggcatcatgaaaccggatctgggacttttacggaacagaagcatcctggataacatcattttttccctgagggcgacggggcactatggaagaaagatggaggagcttgccagggcgtcactggggataaccggtatgcttcataaaatgaatgcctatccggatgagctttccggaggagaaaatgccaaggcgctgcttgccagggcaatttccggaaaccccaggatactggtgctggatgaacctacggcaaacctggatcccgacagctcctgggatatcttctgcctgctggaggaactgaaccggcagggaatgacgatactcgcggcgagccatgaccgtgaaatggtaagtgttatgagaaaacgggtcataacactttcggcgggacgggttgttgcagacgaaagacgggccatatacaatgcgatggctgccgatatattggaagaaagaagagtgctcaatgaaaggcaattacttagaggcagagaaattaattgactgtctgaaggcagttatcaaccaacagaaaataccggccaatgatattctgatgaattgggaactgttttttaaaacagcagattttcatcatgtttccaacatggtttactacacggtcatggggatgaagcagggaattccccaggagtggccgaaccggtttgcggtccgttacagaaaggctgtagcggcggaggagcagtacaggaaccttgtggaagccgtgctctggaattgcgatcagaacggcattcatgtgatggctctggacgacgccatatatcccggcttttatcccatgcgtgagatgcggctggtggacaaagcggatttctgggtagagggaaaaaaacggggagagctggaccggatgatgtactgtcttgacttcataccggaggaaaacacacagcccggggtataccgctataccagatcgggagtctgtcttactttttatgagaagcttatatttggaaataagaagcttaccaggtatttcagcatgcccgtaaaatcactgccgagaaaagaagacagcctgtatgtccataaaatggaagaacccggattgtttatctatcttatgtgcagcaaagcccagcggttcgtggacggtgaatttgatttgagggatatggtggatatctggctgtattacagggccgtggttagaggaagcagctggaaatacatcatgaagcagctgggcagactggaagtatggaatttcaccaataagatgctcgacctgaccgatatctggttcggaggcggcggggtgggagaggcagagtctcaggaaacctttgaagaactggaaaattatatatttttcaagggagcgcagggacaggaaacagccatgcagatcctgccgcttctgaaacagaccatccgggaaaagcggaaaaaacaaaagaaagaaaagcggataaaaatccagaagtggatgtttcccgacagggaatacatgaccatgatatatccgagaatgggaaaataccgtattctgctccctctgtgctggatgagaagacttgtccgcagcttttttatctatataaagacgaaactcagaaaaaagagaaaaatggaaaacgtttcttaatattttacagattgtgacgataatttaggtaaagaggtgattgtatgaaaatatctatggaacatattcataatatgtaccgccagaatgaagcacagtctgtaaaaaaagatgaaaatgaatatggaataaacaggaaacgcaattttgatgaaataaaaatcagcgcccagacagaaatgattcctggagaaacggagtttgccaaaatactcgctgaaaagctgtcagcggaggtgaggcaggaggctcctgctgaaaagctggatatcctcagggaaaaaatccggaccggatgctatgaaatagatgtttccgccattgcatcaaggatacttttggaagataaaggagatagttaagatggaggaactgaagaaaattattgttgagctgaacagtgtttttgaggaactgataccgatagaaagaaataagctgacagcggctgccgaccataatgtggtggagctggaagaatgcatgaaaagggaacaggtggcaattcttcagctgaaggggcttgatcagagaagggaagccctgcagcagaagcatgggtggaacggaatgagcttccggcagctggcggaaaacctggatgaggaagaaaaggcagatattcagccggtgtttgatgagctggatcggaatctgcagtccttccgtgatatcaacggggatgtgaatgaagtgattaagacgaatcttcacgtagttgagaacatgcttgacaaaacgggaccatattccgaacagggcaaggaaaaagaaacagagaaacattacacgagcagaaaggcttagaggaggtaacacatgcggtcaacattttcaggcctgaacatggcgctgctgggtatgaatgccagccagagagcgctggatgtgacgggacagaatcttactaatattaataccagcggctatacgagacagcgtctggatctggcgagtatcagccctaccggtgcagaatatttcaataccaaatacgcggttaaggtaggccagggtgtactgatgaccggggtgagccagataagggacccttttctggatatccagttcagaaaccagctctccagggtgggcagtgtggatgcgaagaatcaggtgctgacaggtattggtgatgtatttgataatgtggatgtgactacagtacaaaatgccctggatgatgtggtaaagcagctgcagacactttccacaaaagtgggacagaacggtaatgataatctggtccgttcttcctttgaagttctgctttcttatatacaccagaatgctacggatttgtcgaaggtacgtacggaactggaatcgaagatggagacgacagtaattccggatattaacaagattctgacctctatacagcaattaaatgaatccatcaaacaaagccaggttttgggaagccccgctcttgagcttaaggataagaggaatcagctgattgatgatctggcaacctatcttcccattgatgtggtttatggagaagaggttgtcggcggcagtttcaaggtggaaaccatgagtattaagcttaaggatgatttcaataatccgccggaagatgcctatcttatacaggatgatcaggcaggttccctgaagtattccattgatccggcaaccggggaaagcaagattgatctggaatatctggattctacgggaaacataagacatgatacagatgctgcggataagtttactgaaggtatcctgaaagggaatctggatatgcttaataaggaaggcatatttgatggctcggatgtaaaggggattggatattatcagaaaatgtttgattctttcgtcaatacgctggctacaaaaatgaacgagatgaatacctttacagatggattaggaaataatctgtacgacggaggtcctttgttcgaggcagagggaggcgggactattacagccgccaatattaaaatatcagacggctggatggatggtaccgttcggctggtagcggatgagacggatgatccggacaacacttcaggaaagaatattctgaagatgagtaatcttctgtctaccgataccattgaatttatgggaacgaatagttctggagtttccattcaggtcttcaagggaactatgccgggagcttatgccaatatacaggcagaacagggtattgagaaaaaatcaacagagtccattcttgataaccgggtaacagtattggctaattcggcagatgccagggactccgtaatgggagtgaatatggacgaggaggttatgaatctgatgcgctatcagcagtcatacagtgctgcagccagacttatgacaacaatggatgaggcattggataagctgataaataatacaggtgtcgtaggcagataacaggaggattgagcagatgagaataacgacaaatatgctgatgagaaattatcagaacagcctgagcaaaaatatcggcggattgtcggaagcacgcaacgcggttctgacagggcgcaggtttaccaaagcttcggaagatcccggaggtgcgctttcagcatctttgctggaaagaaaatatgtgaggaataaaagctatctcaccacactgacggaggtgcagtccaaacaggatgcgcaggaagatgcgattatgcagatgacaaatatctgcaagacgattgacagggattattcggtcagtgccatgaacggaagcaatcaggaaaagagtatacgcgccacatatgccgcagccatgaaggaactgcagcggtctatggtcagcagcctgaacgcccagtatggggatgaatttgtttttgcaggtgcgggcggcatgaaggctccgtttgaattgagtgacagcggcgtccttacctacagaggaattgatgttaatacaacggacccggctgaactggccaagctgcaggaatattccaaagaggggacctatgtggatatcggcttcggccttaattttgacagcagtggtgaggtggttccttccagcgcatttaatacggctcttcccggtatcaatgtagtgggattgggtgataaaaatctggttactacaatcgggaaaatggtaaaggtgctggaggccgatactttcgacagggatgcatatgcagaactctggacagacttcagggaaggcacgaacaccttgaatgatatgaccaccaagctgggtaccaaaaccactctgctggaggcgacgaagacgaggcttaccgatctggatctttctctgtccactcagatcgacagcattgtaaatgtggatcctgcagaggcgattatgaatttctcatgggcgaattatacctatactacggcattaaaaataggaacaaatattatctctccgtcattacttgattttatgcgttagttttcataagcgggaggtgtttgagtgatggaacaacttttacagattaaaactattccggtcaattatgagctgacagtccataatgcaagactggaaataaaaagcggaacggctgagctggaaatcagccgtgataaaggcggcatgcatattaaaagccgtcccgtaaagctgaatattgatacgtttgaagcgcgtaattcagtagtgcccactgcggcaaccgccattaagcaggctgcgagcagggggaaaagtgcttcgtatgaggccacggctcagtatgcatccgaagggaagctgatgcttaagacccagattggtgagggaaacgaaatgctgaatcaaattatcggacagcgtgtggcccagccggaaggcaatttcaatataaaattcataccttctcagggtgcgaagttctcttatgaggcgccgtctctttccatagagtatgagatggataaactgcagtttgatttgaaggtggaaaagggacgggtggaatttattcccggcacaattgaactttcgattacccagcagccggatgtgatcattgaatatgtgggcaaacccatatatgtgcccccgagtgtggcagctcattttaacggtgagaatattaatgtaaaggcgtgactgaaataacgtttacccgcgtggtaacgaagaaaatggagtatggatatgaaagcggatacaatgtattttggtatgcttgaattcaataaggaagaattaatttgttttgaagaaggtctttttggttttgaaaaccgaaaagactttctccctgttccttttgaggcggaggatgataccattctctgcctgcagagtattgaagacagggatacctcttttattattatgaatcctttccggctgtcgccggattataatccccaattaaagcccgaggactataaaaggctggggacttcgagggaagaggatttatcttattatgtgatatgtgttatccgtaatacgccggaagaaagtacggtaaaccttaaatgccctgttgtggtgaattccgttacgaggaaagcgattcaggtgattctggaggacgggaactacaggttccgtcattccctttctgaattttccggaagggaggtctgatatgctggtacttcgaagaaaaaaaggcgaggcaatcaaaataggtgataatatcaccgtgactgtttccgatataggccaggattgtgtccagattgccattgatgcgccgagggaaatcagtattctgcgttctgagctggcggaagccgccaaggtaaaccaggagtcggccaaagttgaccgcgagtcgataaagaatctgaaaaacatgctgaagaatcaaaaggataagacgaatacatgaagaaaataaggttaacggtaactgctttttttagtataatcattctgtttacggcttttattatctttttcaggctgcagacagaggcggcaaaccgttccacaggggatttgaaggtgaccggcggcagctatggcgaggattaccggtacgaaaacaacacccttgttattttatcggataaaccggttaccatctccggagaaacaaaaaaagatcggattcaggtgaagacgggtgttgatgcgaacctgacactgaagaatctggatataaggaccagcggctgcgcgctggatgcgggagacgggaaggtctccataaaattcagcggcagcaattatgtgaaaagcggcgccaagtatgcaggaattcgtgtgcaggagggggcgcaggtgactctctccggagggaaaaaggatacgctcatggtcttcgggggaagccaggcagccgggatcggcagtgaaaaggatatggcctttggcaaaattactgtttcgggggggacagtgactgccaccggcggagccagggcagccggaatcggcagcggttatcagggaacaggaggagatatcctgttaaaaggcggctgtatcagtgcatacgggggagcgggagctgccgatttgggctctccccaggaacaggacggaaagggtacggttaccctgaacggaaacagtatgctgttcgctgatgatatcctggatgaattcaaaaaagaaaatgggatctggcagtcaaaaaatacgattgaagtgtatcagaaggtcactcttacctatcctctggaaatcggcagcggccggaagctggtaattcctccggatggagagcttgccatacctgaaggtacggagtgtgtgaataagggtgaaatttatgcttacggcatattggatgtgtccgggacactccgtaatgaaggggagatttatgattatcagggagacctggaggaggtttccggaataacggggaagcaggcttctttccgtgatttaaaggatatttacctttctgatggaaccatcctttttacgcaagacggttatgaacagaacggcatgcagttcctcattgtggacagttcttacagaggatatacaatttatggagacggaaaagaacataaagcctcaatagaggtgtcctccggcgtatcggtgagctgtactctggaggatgtgctgctttcccccgaagggaatgcatatgcattaactgtgggagaaggagcggaggctgtccttacattaaaaggagagaatacatttaccggcggagccagcccgatatcaggaagtatcctcatgcagaaggatgcggaacttgagttaaagggcaatggttccctcacattacaaagcgggaacggaagcaaaatggttctgagcggtgacggttccgctgacgatgaagaagagcttccggaagaggaagcggacgaagagactgaggttcggataacagaggatgaaaagaagatggaggccttcctggaacgcgacatgctggaacggctgtctgatgcaggtgagtccctggatatcaacggcagaatggcgcggatccgtttgaatggacggggaattgacgaacttctggcggcaaccgcaggggatatcaaggttcgtgtgcgtccgtttgtcctgacggataaatttacagaaggaaagctttacatagaggacaggccggttctggatatacaggttctggaggtgctgggagaagaggaagagatagttgatatccacttcaaaaatggcctggttaccctttctatcccctatcagaagccatcggcggaagatgccggaaatctaggcctcgtatatgttggggcggacaacactcttgactggattaagaattcttattatgacggtgataaaaaagtcatggtatccgatgtaacacatttttccgtttacggaatcggatataaaagcccggcggccaaggatagtgaacagaagtccacagtatccgggaatacggtaaataagcaataaatataagaataagaggaataaaaaatcagcgataccggaagaggatatcgctgattttattatcagtgtattttatttaagtaatttgtcagcactctgggaatattggcacaggaggcctggacattgacagcgcctatattatgcgccaccatgggcatgccgtagacaacacaggaatccttatcctggccgatagtataggcgcctgcccttcgcatcttcaggagtccgtccgcgccgtcatgccccattcccgtcagaataacgcccaccgcgtcgctttttgccacatcggcaacggaacggaacaggacgtcaacggagggcctgtggccgtttaccttatctgccgagaagcagttgacggtgtaggaagagccgagccgtaccaccttcatgtgaaggcttccgggggcaatcagcacggtgccgcgctctattttgtctccggtacaggcttcctttacatgaagcctgcaaaggcggttaagacgttccgcatacatttttgtgaaaccctcaggcatatgctgagtgattacaataccgggaatgttttcgggaagtgcctgaagaatctggagagtggcttctgtgcctccggtagaagccccgatggcaatgatcatggaattcagtttcgcaggattgataggactgagtcttgggactatgggagaaaggggctctttttttacagaagacgggcctgccacacgcactttggagcgggaagcaatgatgattttagatgccaggctgtcgacgaattcctgacggccgaagttggcggcgggatttggctttttgacaaaatccacggcgccgtttgagagcgcctcgaagacgttcatgtttacggcggataccaggataaccggtatcggatgcttgggcatgacctgtttcaggaattctatcccgttcattttaggcatttccacatccatggtgatgacatccggtgcacactggggtattttttcaatggcctcatacgcattggcagcatatccaacgatttggatacggctgtttgccttaggcagattgctggtaagaaaacggccgaagaccagtgaatcatcgacaaccagaactttaataggagtattaagtagcatattcatatcgcctttctgatatttctaaaggatacgggctattttctatatgttgccggcattatgtaattatagcgggtcgtggttttgttaaggctttcggagtggccgattaacaggtaaccgccgggggcggtggcattataaaacctttctattaatccgttcttcgttgcctggtcaaaataaatcattacattccggcagaaaatcacatcaaattttaattggaaacgtataggatccatgagattgaaggtcctgaaaataacgttggatttcaggttctgttttacggtccagataccgggttccgctgtccggtcaaagtatttgctcttccatagcggaggaagcttagacagggattcctcatcatactgggcattctgggcggccgtaagggcattctgggatatatccgtggccagcaccctggtatcccacatggcggctttattgccgaaatattcttttaatatcatggaaatggtatagggctcctggccggtggagcagcccgcgctccagatgcttaatacgtgatccgtctttgtcctttccagataagggaggattgtttcacggaagaaggtgaaatgctcttcctccctcataaagtaggtataatttgtagtaagacggtttagcatactgtcaatgtccgccgggctggccttggtgaggatatcattcacatagtctgtaaagttggtatatccctttgcgaggatatcattggataatcttccgataatcagctgtcttttcttggagagatcgataccatatttacttttgataaaagtatataagcgtttaaaatcattatcacttatagtcagcattatattggctcctgtctgttttagtgtttattcaacaagcgcttcgtagttcaacagcagaataacggttccgtccggtaaagataccatgccgttggttaattcctgtctgctttcaaccggaattgacgaggtctggcgtaagtcaatatcaagtacctgggacacgctgtccaccatcatgcctatggtgttggattcaacctgaaggatgatggtgctgttggattccaggtcttccatacagccaaggcgcagacggaaatcaatgataggaatgatctgccctctcaggttgatgatgccctttatatattcggggacaagagggacgggccgtatggaataatcggtaatgatttccacaacatgcatggtgtccacaccataggtcagtccgtttgctataaaggtaagatagcttctgatattggtattttcttcaatcatctgttcttcatctgttctgtcgtttatttgttcagccattttaaagcctccataattttattgatcatatgcgggccggtatacggcctctgttatccgggcgcagtttaaaaaagggactgtgccgaatgatatacattggcgatatccagtatgatactgatatttccgtctcccagaatcgtacagccgctgattccggaattcttgatattaaaattgttcagatagggagggagaggctttacaacaacctgctgttctcccaaaagctcatctatgaacaggcagtaggacttgtcgctggcatccacccacataagaagtccgtcttccaggctggtgatggcgtcgttgatgttatacagctggtgaagacgtacaagagggtaaaaatcacccatgcagcgtatcatctcatggccttcggaatcatagatgatatcctccggaagagccttgaaggacttgcggatattggagataggcacggtgaaaatagtgccgccgacactgacctccatgccgtccacaatggccagggtgagaggaatgcgcagtgtcatgcaggtcccctttccgtattcactggttatggttacggtaccgcctatgctttccacattccgttttacaacatccatacccacgccgcgccctgaatattccgttacctccttattggtggagaagccgggaagcatcaggagagagaggatttccttctggctgtattcttcttccggttttgtaagaatgccgttttcacgggcctttgccaggacggaagcgggatcgattccctttccgtcatcccttacggtaatgataacctcactgccggtatggcgggcggataaaagaacctcgccctgaggattcttcccggcgtcaatacgttcctgcgccgttttttcaattccgtgatccatggagttgcggacgatatgcatgataggatcgctgatattatccacaatgcttttgtcaacctccgtttcttccccttctattgtcagccgcacatccttattcagttcctgcttcatatcacggacgatacggttcattttctggaaggttccggaaatgggcaccatacgaagagacatggcgatatcctgcagatcatcggtgagcttgcgcagctgtcttgcggatttcaggaagctgtcaagcttcaggccatgaagctcaggggaagatattaccatggattcggtaatgacgatttctcccacaacagccatgagcatatccagcttggaaaggttgacactgattaaattctgctttacaggagcattatgggcggcgggagccgcaggctttttagcgggggcggcggccgttttaccggtattccgggcttcctcttccgctgcctttgctgcttccctcaccgcataagccggattgtcaatcagttcataggaacggatattgctgctgtcctttatgatggtgatggctatttcggccgtttcctttgaatcgaaagcgaaataaaacccgtcctgtactatgctctcggctgaattgctgtttgtttcaatatccgcaggataaaagcggaaatcagaagtggcgtcctttacagaggtgaccagcatgaaggcccggagattttccatgccgcagccctcatcaaagaaaatatgtacaaaacacattcccttgtcttcaggaagatgggacgctggaatttcctggccggcagcagcttcaggagcggcattctgtggggtttccgtaacagccgcagtgtcttccgatccgccttccgtttctttgtcactgattttgtcaagaaaactattaatttctgttgttacattgtcgatattagtactgagaggttcattattttccaccttctgcacttcttcgcgcagcttatcggtagatttgaacatgaggttaaacagttcggacttgtgcgtgctgtctaacttgctgattccattctcccgaatataaaagaacaggtcttcgatgtgatgtgcaatggtcatgagggaagtaaactcaagcattgcggaagaacctttaattgtgtgcatgatacggaagatttcattcacgtcatctgatgtgaaatccgtattcttttccgcatttattaacaactcatcaagctgttccagaagagaattcgtttcgaataaataggtatcaagtagattgtccaggttgttgtccataatctttacaccgccttatctgtcagttatatttttgtacttaaaacacatacttatatatcggcagaatacattaaaaaataattggagtcagagaaaaaatgtctaatattttaaaagttaccagtcccatagggggatatgaaaacggcaacaatataaaaatgaatccgaccgcaaacgcggaggttcagggcgtacaggcgccgattaccccccagaaggtatccaggccgggagggcgggatgatgcaggtcagaacagcacacagctgaaactgaattatgaatctaattttaaccattttataaagctgcttaacaattcgcctgatcaggtggaggatctgatgcggcttcttatggaaaaaaaggagctgcttgtacaggcgggcatgaataaggggacagcggaggatatcgcccggtttttctccatgatcggactgaaggagggcaatatgtcggcattcctgaaggaacaggccgatatgggaatccgctacagaggaccgttttttgatttgctccggcaggtgttcaacaacacggattccgtggatttaaaggcggggctccttgattttgtaaggcgttatggagacatggcctccggcggccacattatgcagtccatttcagaactgctggaaaaatgcagggaacaaatgttcagcaaatcagccggtgagctggagcggatggccgcccgtcttaagacgggagagcagcatgtgaacggggatacacagaagaacgccgcactgctgaaggaaaagattcttccttttctgaacaagtatatatccgccacccatgacagagggctgctgcgtcagtataccgcgcatctggcataccagcttgcccgttatgaaaacggaagcatggacggactgatgcaggcattcgggaaattaatgggtttccagggctttaaaaaggtcttcggaagtatggatgaggcgctgatagaatcggtcctgcgcaaggcctcacaggcggatgaaggctggaataaagagtttttaaatatcctgcgttccggtatgaacggggacgccagcacggaaggaaagatgataagccagaattttgtccattccatgcttttgaatgagagcgtgtatatgccggtcctccacctcatgcttcccatgatggtggacggcaggctgatgtattcggagctctgggtggatccggatgacaaaggggccgccgaagatgacgaggaggatggccgtgttgtaaaggctttaattaagtttgatattgaaaaattgggatttttcgacatgttctttgtttataaaaacgggaagatggatatgcagctggattttccggataatctgaaggggaaagaaaaggaaataaggcagaatataaatcgtatcatggccgaaaacggaatccggctgcagaatctggtcaccggatccagccaggaatccataccgattacggaagcatttccgaaaatttacgaaaggaagaatggagtaaatgtcagagtttagggaaacattgaataaaaaagccgtagcgctcacttatgatgaggataaacagaacgcgccggttattgtggcttccggaatgggatatatggcggagaagattgtggagatagcatcggaaaacggtgttcctgtctatgaggatgattcccttgccacagtccttacacagctggagctgggaagtgaaataccggaggagctgtatcaggccgtggttgatatttatgcttattttttgcattttacactgaacggggaagagaaaaaaacagaagccgccaaaccggaagcggtaagtctggaagaagaaatgcaggaggaataagggagcggcattcattgccatatcctcctgccgattataaagtccgcaacgaaaaaagccatcccggcgttaatacgctgagggatggcttttttgccgtccgatgttattttttatggatggattccatgtggaagataaatctccgcagcaggctttccgtgtaagaggagagatcctcgaaacagcagccataaccatatttcccattactcagaggttctgtccgcaggacccgtgtctggggggcgatgggcaggacattatgctgaaaatgggtatagaaaacctggacgggaagcttctgcgctgcgataatatatacgcctccggcggaaatattggaggtcacgccgcctataccgccgcttcgtcccgtttcggggtcaatgtatgacatatttacggttattgtcagcggaaggcggaagtcttcatgacggtcggctgtatttttaacggacaggatatggcagaagccatggtaatatccctttttgtctatcacaggctcgatttggcaaatgctgcagttgcaggtcaccagaccgtttattgaatcaaaaaataccacaggcatcagataagcttcctccattaccagctcccatccgggaaaggtaaggtatatttcattttctcttgtatagcttacagcggcttcactgagcaccgcgccggtctgtggatcaagaatatgacattttctacagttttttattgataaatccatataggcctccgggaaaaaattttatgctgcataggagcagatgtcactatttattatcggattggatgcttaaaattaaagggaggacttgtcaggaaattttctttttacatttcagaaggtaccaagaacaagttcagcgtctttataatagatattgcagtgttctttagtgtcttttatgatgagatgggaatgattgagactgatttctgtaacaccatagataatatcgcttttcacacggcatttgctgtaattcggttttgcccgcagcattttgtcgatttgttcattgagatccttcacctttttttcgtaaagtgctttttgttcacttaaaatattgaaaatttcttttttgttttcaggaacggagggctgttccgtcagataacggtaattcagacggattttttcgagtgttttaacagcctcttccaattcggccgacaaatgctccgtgttcttttcttcctgcacagcctggccgattgttatccgtgtttcattattggacggcgtgccgattttcctggcctccacactttttgacgcgctgatatttcctccgataatggtaccgcgtcctgacagggccagaacggagcctccgcagatgatattgctgttaatgatggtttcggaggatacatttccgttggccgtcacccgaacatgctccaggaaaagggaagaaacattgcctccggccttcaaaaaaccaccgccgcttccattcatgccctttctgatttctatgtcctctcctgccgtgacagaagcattttccaccatcccgtaaacaataacatttccgccggcatggaccgtaaatccccggcagatatcgtccattaccagaatatcgcccgcaaaatccaggtttcctaccgaaccgtccacgcttccgggaattgtcagccgggatgccacacggaagacgtcgttttgaaaggaaatctctccgcttacctttgccgtgagagccgttttttcttcattcaggaccgtattttttccctgggggataaccggtgcgtttccttttttggcgggcacggcatggcccagcacatcggtgccgtccgttccgtcaccgggcgggatgatatcacagataacatcaccggcttcaatgttctggaaaaggttcagatccttataattaatacttccgcgggagtcctcctgaaggtgaatctgcctgattctggaaaaatggtcgactatttttccgttttccccatcaacgggaggggtgccccgggcgatgggaaaaacacagtaatagcttctgtgctgataaatctgcttcagaaggtccatgtcgattcctgtggttatcccggcgtcttgtgccgcagaaataatatcgttttcctcaggttcggcgccgccgtctgtgggaggaaggagatacagaaaagcggtcatgcggtccggggacagaaggatccgtacagcggcatccgcgggctccggattttcagcgtgctgtccgcagatttccattatttcaggaagacggctttggatgaattccagatcctgcgggtattccgcctgacggctttgcagctcctggagaagagtctgcgcagaaaaggcaatgacgccggattcccgggaatcggtttctttatcaggagtaatttcggagcttgtgtccgcaggcaccggaggaggggctgcagcggagttttcttttttattttttgatttcttaaaaaatggcatatgtttccactcctctttatctgatatagactattgttatattatcggcttgttttggcggaaattaaggggggtggggataaacgcctgaatcacagccgtcatgccgccctgccccggccggtcctgtttccttcctgagcgagggggagcgctgtgtatgtgttctgtgacccagcttcaaaaaaggggtgtttcttaatattccgttccgccggaattctgctgacgcggcagaactcctcgcggtgttaattattggttttgaaccagaggggggtggcgctcgtcagacaggccgctaagggcagcagaattccggcggaacggaatattaagaaacatctccttttttcagatgggtcacagaacacatacacagcgctccccctcgctcgggaaggaaacagggacggcggggcagggcggcatgacggctgtgattcaggcatttatcctggcgaaggtagttggtatggggaggtatcgtttagatgatatggggctgtatgttgttggagggatgtaaaaaatgcagtgatttttcgtttcaggaatgaattttttgatagggttctcttgtgaatatgtttttctcagtatgacaaataatgcagggggatggatttatttggtaaatatgtgtttcttaactggtagtaaatgaaatagttaactgacgggcaaaaattgggttggtatgaaatgctgttatggagaatcaaaatgacggtaaaattgtgccgggctgccattttatggaaggacacgaaattccgtaattttttacttgctggtaacaggagggatatcttgatcataatatatcagaaaagaggcataaaacgtgaaaaagataaggaaaattcttgcctgcggtcatggggatttgaataaagaaacagattttgttgacttaatatcgtttaaaataaatgtaattataaaacgtttaattgaattagaaaatattgtaaaaagaatatataaacaaaaaatacacataaacgatcatatgaaaatgttaaaaaacgttaaatgttataaaaattcagaaatatacttaaaaatgtttgtagaaaataataaaaaatacttttgtaattgctaaaatgtgatataataggctagcagtctacatatgatacgaggtgtaattaatgtttattgtaccgataacaaaaatggagccttctcttactcttgaggaactgaaaaagagtgaaggaagtcagctgccgtctgaagggaaagaattcggcagctttttaaaggaagcgatcagggaagccgaccaggccctgcaggaaacttcggaaatggacaggaagctcgctctgggagagatagatgatctgcattccgctatgattcaggcggaacagtcagctgctgcggtggagtttactacccagctgaccagtaaggcggtaagcgcatacaatcagataatgggaatgcaggtataaacttgctgcggtggagatagatgagtataaaggataatgtgaaggctaaggtggagagcaataagacccttaaccgcttttttggcggaaagaagcttgttttggcggtcggtatcgcagcagctgttttggttgcattgggagcagcgatttttcttaatgtaaaaaatacgggaaaatatgaagtgctgtttccgggaatatctgtggatgagaatacggaagtgtataccgtgctgagaagccgcggagtggatgcaaagcgtaatgaatcaggggaggttacggttccggaagcggagctgggggatatcatgctggatatgtccctgctgggatatcccaagacggccctgccttttaatattttttctgataatacgggttttacgaccacggaattcgagaagaagcagtatcttcttttgaaccttcaggatcgtctggagcggacgctgaaggatatgagcgggatttccaatgccatcgtaaccctgaatgtttctgatgacagtatctatgtctgggatgagcaaagctcggacagtacaggttctgtctctttgacgttagtgccttcttatgagctgtccccggaaaaggtcgcagccatcaagaagctggtagccaacagcgtgcccaggcttcttccggaaaacgttgccgtaatcaatgcggtgactatggaagagctgcaggggcagagcctggacagcgggagctattacgggctggatcgtctggattttgaatccaaggtggaaaagcgtctggaagataagatcatgaatgtgctgactctggcatataagcccagccagattcgtgtatccgccacagtcgtcatcgattatgacaagatgattacggaaaatatgcagtatgttccccaggaaaacggcagcggggttgtgggaaagtcggaagaaagcaaatcccagggctctacccagggggcgggcggtgtggccggagaggaaaataataccgatattccttcttacgggacggcggacagcggacagggcgggacgcagtcggaggagtattacaataacgtggattacctggtgggatatattaagcagcagatagaaaaggataatgtgaagctgcagaaagccaccgtatcggttacggttaatgataataacctgacggaaaacagaaaacagcagctgattgacacggtttccaaggctgccaatatcgcgccggaggacattgtcataaccagcttccggcagaccgaggttcagccggaaaccgtccagccggagaaaaaagagaccgaaccgcagggtattgtttgggacaggaatacactctttcttgcaggagccgggctgctcatccttctgctgctgatttttctgcttgtacacaggagcagaagacataacagagaagatgaagagatgtttgcccgggcggagaatcagggggatggagccgccgttctggaacgggccggtgagggagccgttgtgaatacgataggaagcggaacccaggatcctgtgggagcagcagaagaaaatcccatggatcaggtacgcagctttgccaaaaccaacccggaaattattgcggctatgattaagtcctggctgaaggaaggaaatgagtaatatggctacagaagatagaagcgctgcggagaaggcggcggcggtgatatccgttatcggggtggaaaatgcatccgaggtcctcaggcacctttccgaaggggaaatcgaacagctgtccgtggaactctcccgtcttcccaagatttcaagcggcgagctggaagaaatatcaaaagatttttatgaatgctgtgtgacggaaaaagtgatagcaggcggcggccgggaatacgccaaagaggtgctggaaaaggcgttcgggcagcagcaggcaagaagcatgatggacagggtcagcaaagccctgcataccaaatccttttcttttataaggaaagttgattataaatccctgatggctgtcattcagaatgaacatccccagacgctggcctttatcctctcttatgccaacgcggagcaggcctccaaaatcatagcggagctgcccggagatatccggattgatgtggtggagcgcatcgccggaatggaacgtgcctatcctcccatcgtcaaggtggttgaggaagtggtccggggaaaaataggggtatccgcttcagaggatgccatggagatcggcgggctgaattatgtggctgatgtgatgaaccatgtggaccgcagcacggagaaggatattttcgatgagttgaatatcaagaatccccgcctggcggaaggcgtcagaaagctcatgtttgtatttgaggatatcgcctatctggatcccatgtccatccagcgttttatccgggataccgattccagggatctggccgtggccctgaaggtggctaacagagatgtgaccaatgcgattttttccaatatgtcaactcgtatgagggaaagcatacagacggatatgaagtttctgcataatctccggatgagttcggtagaggaagcgcagcagagaattgtttccaccatccgccgtctggaggaggaaggggaaattgtgatttccaaagatggaaaggatgaagtaattgtctagaattattaaaagcggtcagaccgtatatcaggatcttgaggtggccgtatatggagaaaccttcgaatcgacggaagaggaagacgggccggcagctcaggaagagagctatacactgatctcggaagaaaaaaggcatattctggagcacgcaagaaaccaggcccgggaatccatggcggagatcctttcggatgcttacgcacagagagataaaatagtgaacacggcggaaaaagaggctgtgaggatccgggaacagggacatgagcagggactggaggaagccttatcatcggtggaggacctcaccgtccgcctgcggcaggaaataggggaagcctatgaacggatggagaaccagctggaggatatccgcagccagattgtggagctgtccctggacatcgccggcaaaatcctggaaaagcggattgaagaggacagcggggaaatggcagagctggtaaaaaaggccattcagtctgaacgggataaaaagaagattgacatacatatttccgcaaaagccctggagcttgcggaagcactggaaaaggaactggaaccccttcaggaaaaatacggagggaccataagagtgaaaaaagaagaatgtccgccggacagggtacggatagaaaccagtgacgggattctggatgcttcggtgttccggcagctggaacagctgaaatgccagctggcctctctggaggggcagatatgaggatggaaacagaaaaagtccgtgattatttaaaacgggcggatttgtacacctatatggggcgtatcgataaaattgtaggaaccacggtggaagccacagggccggaatgccgtatcggtgatgtatgtacgatagaggtggcgggaagcagccgggagatggctgctgaggtggtgggcttccgggaaaacaaggtcctgctgatgccctacgaggatatcgaaggaatcggttacggcagcgcggttcacaataccggcagcaagcttctgattccggtggccgacagcctgatcggacgtacggtggacgcgctcggccagccaattgacggagggcctcccgtggaacagccggccttttaccccattaccggagtatcctccaaccctatggacaggccgcgtatcgataccgccatccagatgggagtaaaagccattgacggccttttgaccataggaaagggccagagaatgggaatatttgccggaagcggcgtgggcaaaagtacgctgatgggtatgattgccaaaaacgtgaaggcggatgttaacgtaatcgccctggtgggggaacgaagccgtgaagtggtggaattcattaaccgggatctgggggaggaagggctgaaacgatcggtcctggtggtggcaacctccaaccagtccgccatgatgcgtgccaaatgtacgatgacagccaccacgattgcagaatatttccgggatcaggggaaggatgtgcttcttatgatggattccctgacccgttttgccatggcacagagggaaatcggcctgagtatcggagagccgcccgtggccagaggctatacaccttccatttattcggagctgccaagacttttggaacgttccggtaatttcgaacagggctccatcacaggcatttataccgttcttgtggaaggggacgatgccaatgaaccgatttccgatacggtgcgcggtatcatagacggccatatcatgctttccaggaaggtggctaccagcaaccgctatccggcgattgatatcctttccagcatcagccgtctgatgaacgaaatcgttctgccggagcataaggaagccgccggaaggctgcggaaaatgctttctgtttatgaaagcaacctggatctggtatccataggcgcttacaaaaaagggacgaatccggaactggatgaagcgctggagaggatccggcagatttacgatttcctgcagcagaagacggatgaaagctttaccctggaagaaacggtgcttcagatgatcaaactgatgcagtaggaggcagtcaatgaaaaagtttaactttcccctggaacggatgctgaattatcaggaacaggatctggaaaaggaacgggggattatgagccggcttctggcagccaggacggggcttgaagaaaaaaggctgagacttatggaggaaatggaagaaatacagtccgaacggggaaaggaaatccgtaaaggaaccaccattttttccctgcgttcgtccagcgtgctgctggtcagcgggaagaaacagctggaggaaatccggaatgaactgaaccgcatcgatgaggaaatcgaaaaacagcgccagatagtggtcagcgtttcccaggaagtgaaaaagctggaaaacctgaaagaaaaacagttggaggaataccgccatgcagaagcaaaggaagagcaggagatgatatctgagcatgtttccggcagcttcgtgcgcaatggcgtttcctatatatgattcctgcctcctgtggcgggaagaaatggaaaagaaaggtggtgaaaaacatgacagtacagacagtacagaacgcaggaataacaggaacgggtaaggataaccggcaaagcgccgcggcccgggacacttttatggagatgctgaatactcatctgaatcaggcgtccgacagaaaaaatgcgaatgcaggcccgggaaaagcggcatcacagcccggtcagaaaagcggtgagccagtgaaaaaagaagaaaacgcagccggaaaagcatcgcgggatacgcaggataaggccggggatgccctgaaggaaactgccgggaatgcggaagacaaacccgcagacaaggtggaaaaaccgggcaaagaacagacagaagcggcagcgggaatcctgatggaggaacagatgcagcagaatggctgggaaatgattctgcccggggaggagctttccggaaataccggcagcagggaagaagaaatgtctctttccggtattgtgcagacagccaatgcggcagaagcgtttccgggaggaagcgaacaaaatccagcggccattattaatacggcggcgggggaaacgcagtacgcccggggaaagaaaactgacagacagacagccggaacggcagaagatatttctgtcctgaaagacagcggactggaaaatgcggcacaggccggcagtaccggtgtaaaagcagccggaaacgggcaggaagcttttggagacagcgcatcctcctatggggatatgctgaaggaacagtcggagcttctgaaagccatggcagggataggcaaagaggaaaaagataccgaaatctcttatgttttgcaggacaaagaaaccgataccgaggccctgcagaaaaaggtggatgaaaaagcctatcttcccttagatcgcatgatagccgtgagaacggcggacaggccggaaatgacggcagttcccaatacgcagacagaagcggttccggttatgcagcaggtaaaaacaggtctggaggaaggaatggcaaagggcatgaaccattttaccattcgtcttaagccggaaggtctgggagaaatcgtagtccgcatggttacggaaggcggcagaatctccatgcgtatcggcgtgagcaatgaagacacacagcgtctgataaacagcgagctgctccagctgaaggaagctcttcagcctctgaatgcccaggtgcaggaggtttatcacagcggcttcggcggaatggatttttccggataccagcaggatatgtaccggcagcagcatcaaatgacgggcgggatactccgtcactttggagcaacggcagccggagaggaggaagatattccggaaattccggtctataaccggatggaaggaagcttgtacgcttatatctgacaaaaacgggaaaggaggaaacagcccaaatggcagtagacggtttgaacagcagctatgacacctatgcttccgcttatgcaagaagcacggaaaatacagccggagagagcagcggtacaggcaatgtaatcgatgcggtattcgagaaggaatcggacagacaggtttcgattgacgactttctggtgctgatggtggaacagctgaaaaaccaggattttatgaatccggttgacgatacccagtacgtgacacagctcgcacaatttaccaccatgcagcagatgcaggaactggcctataacgcgaaaagcacctatgcaacctctcttgtgggaaaggacgtgacggcggcgaagatcaccgtaaacggcgacctggccacaacggaaggaccggtggagaaggtttccctgctggacggggaatatgtgatatacgtgggaggcaaaggctttaccctggatgaaatcatggaagtgaagccctccagccagagcgacggtgccctgaaaaaaataagcagccagctggaagatatgaataagatgctggacggaaagctgacggaaggctttgaaagcattcggaatgccgcggatagcggtgcggccggcagcgcggatggaaataaagttactggcggaacgcagggaagcggcagcgcagacggaaatgaaggaacagacggaagcgggaacgcggacggagttggcggagtggaaggcagcggaaacgcgggcggaaccggagacggctcgaacgcagacagcccggaaggtgcatagggacgggaaggaggattagggatggatccattacgatataatcaattgctgcaaaggccagtttataccggcaatcccgttgatatccaacaaaaccgggacagcagggagacttccggagaagaaaatacttcttttcagaaggtcctggaagagaaactcagggaagagagtgggatttctttttccaaacacgcgatggaacgcgtggcagaacggaatgtggatgtatccgcagaacagctggaacgcctgaatgagggagttcggctggcagaggaaaaaggcctgagaacgcctttgattcttatggataccacagcttttttagtaaatgtacccaataacaaagtagttaccgtcgtgaatgacgagagcctgaagggcagcgtattcaccaatattgacggaaccgttatgatatagccggtcctttttaggaggctatcttaccccgactgacagaagggtaagaacggtggaaaaggagatttgtaatgttacgatcattatattcggcggtgtccggtatgaaggcacaccagagccagcttgatgttatcggcaataatattgccaatgttaatacatttggttttaaatccagccgcggacgtttttctgatgtgttttaccagacactccagaacgctacgggcggaagcgcaactatgggaggaaccaatgcttcccagatcggttatggtacccagctggctggcatcgacctggacatgagccgttccgcatttcagtccactaacagagggctggatgtggctattgccggagaaggctttttccaggtacaggattcggacggaaatattttctatacaagggccggagcccttcagatcgatcctaacagcgggaacctgacagacgccaatggttatacggtactgggtgtttccggggatccgcttggcaaagctccgggatccaataagatccatctggacattccttcccagcaggcggcgaaagcggtaaaaacggagaccattaacgggatccgctatacgctgacttcagaaaaagcgacgacagatgccaatgtatccgtgaactttgtggtggatgataccctgccggacggagcggacgctgtggtaaaggatacggaaatgaataccggttccctgacggtccgcgtcaatgccaaatctgtgttcagcagcctcagtgatttgatggataaagtgaacactgccattacccaggctaacggaggaaaagaatatcctacaggaaagctgtctctgacagcggtgcctgacggcggcctgttccccgcaggaggtctgactggtgcggaaatcctcggttataacttcgatgtggttccgggagaactgacgctgtccggggcagatgctgcaacgaatggtgtttttggttccatgcttcctaagacggtgagtagtgtacctaaatttactgcagaaggagacgttacatttgaagcgcattatgtcaaagcagtgggtgacaagaaagcagcgtgggaaataacagctaccgtgggaaccggagcgaatgaaaggaaatttgtaggttatatagatgaaagcagtactgcggctaattcggtgcttctgaaagaaagccctgtaaaacccggagaagaagccggacagtatattgaaatgaagcatgaaggctttaccaagctgtcggatgaatggcagcaggctaatgcagggaaggacattgatacagaaacagacccgagtttgacttcccagggaaccagtacagttaccgcatcacaggattccaaagaactcggcctgggacagaagggctttgtcctggaaggcggaaccgcaggcggcacgctgtcctcctcacaggtaggggtttctattttggcgaacggtattgtggaagtcaatcatcccgacaaaggaaaaatccaggtaggccgtattgaccttgccacctttgagaacccgtacggcctggaggaggtgggaaattcctacttccagcagacagctaattccggcaatgccaagctgtgccaggcgggaaccaacggttccggcgctctgaaatcatcggcgctggaaatgtcaaacgttgacatatcctccgagttttccgacatgatagtgacccagagagggttccaggccaactccagaataattacggtatcggataccatcctggaagaactggtaaatctgaagagataacacatacataaaaaataaatggcagagataaggagagggtatccgtgatttttttaagaaagctgaacggggaacgttttgtactgaacccggatttgattgaaatggtttccgaaaatccggataccacaatccttctcaccaacggcaagcatctcatcgtgagggaaaccatggatgaggtagtggaaaaaatacgggaagaacgaaggaacatcgtacgcgagctgctgggcggagccggcccctcctgaaggaggccgaaagaaacaaaagagaaaaggatataacaggttatggacattttgtcgattattggtttgattttggcagttggaatggtgttgttcggaattatgttcgattccgataccacccgggtagtactcgggaatctgcatgcgttctgggattatccaagccttgccataacaataggaggaacgataggcgttatgatgctttcctttccccccagtgcatttaaaaagatcggaaagcatatgcagatcattttccggccccagaagtttgaccccaggcagtctattcaacagatagtggagcttgcgacggaagccagaatgaaagggcttttgtcccttgaagataagctgaatgaaattgatgaaccattcctgcacaacagccttatgctggtagtggattctgtggattcggaaaaggtaaaagcggcgatggaaacggaactggatcagctggatgcacggcacgccctggatcgcagcttttacgagaaagcggccagcttcgctcctgcattcggaatgatcggtaccttaatcggcctgatcctgatgcttggaaacatgcaggatgtgaatgctcttgcgagcggtatggcggtggcccttatcacaaccctctacggttccctgctggcaaacattgtatgtctgcctgtggcaagtaagctgaaggcccggcatgaggaagaatttctgtgcaagcagcttgtcatggaaggggttatagccatacaggagggagaaaatcccagatacattgaagaaaagctctacaaacttctgccggcccacatgaaactcggaaaagaggaagaagagggctcggaagaggaaagcggcacacccagacgtttcggcagaagaaagaagaataatcaggataaaaggagttaggcaaaatggcagcagagcaggaaatccggaatatgtcggaggataatatctttgacgcgcttatggaacaatacggaaaagcagcaggggaatccatctccgccatgcttaagacgaaggtggagatcaaggctccggaaaaatcagaaacactggttaaggatgtggaatacagcattctggaaccggccttgtttgtcaaaagctgcctcacttcgaatgcagccggaaacattgtcatgattttcaggcagcgggatatacaggctttcctgaacaagctgatgggaagcgatgacctgccggatccggattttgaattcgacgaagtggctatgagcgctgcaggggagcttctgaaccagatggtgcacagcgctgccaaatcggtggcggagtacctggaaaatactatggattcttcggactgccagctgtttttatcggacagcggacagcgtctgtgggaaatcatgggagaggatgccgcatgtaagaccactgtcatccgctatggcatgacaattggggatctgatggaaacagaattcctggaatgcatatccgagacggcaacggacagcctgatgcaggaaattacggtgaaaaagcagaaggaggaggaacgggccgtccgggaggaagaagaacgaaacagcatccaaatcatggacagcatgccggacgaaaacggtaccggacttctggccgccgggcggattgacggaaccgcataccgggaaacggcgcagctgcagccggtatccatcccgcagggaaatctgggactgctgatggatgtcccccttcatgtgtctgtggaaatcggtaaaacaagacgtaagctgaaagagattctgagccttaataacggtatggtagtggagcttgataaacaggctgacgcgccggtggacattattgtaaacggccagctgattgcgagaggcgaagtagtggtcatagacgataacttcggggtgcgcatcagtgaaatagtaaataccaaaagtattatagaaaatggtgatctgtaattgaaacgatataacatagtggtgactgccggtgtaatcggaattattttcctgattctgatacccctccctacctttttattagactttttctttatattgaacattaccctgtcgctggtgattctgtgtatggcgatgtatatcagggaaaccctggaattttccgtctttccctcgatgctgctgatcaccacacttttccggctgggacttaatatttcctccacccggaaaatcctgtttgacaacggatatgcaggacaggtggtaaagaccttcggagaatttgtcatccggggaaatgccattatcggatttattattttcctgattatcgtgttggttcagttcatcgtaattaccaaaggctccgagcgtgtggctgaggctgcggcacgttttaccctggatgccatgccgggaaaacagatggcgattgatgcggatctcaataccggcctgatcgatgaacaggaagccagaatcagaagatccaaggtacagcgggaagccgatttcttcggttccatggacggtgccacgaagtttgtaaaaggagatgccattatctctatcatcattacgctgatcaactttataggcggcattctggtagggacaatgaacaaacagggaagcatcaccgagatcatgcagatatacactacctccaccataggcgacggcctggtatcccagataccggcgctgctcatatctgtggctaccggtatgatcgtaacacgctccgcttccgaaaacagcctcagcgaagaggtgacaaggcagttcctcgcccagccccgcgtcattatgatggccggtgcggccgccgcgtgcctgagcctgataccggggttcccggtaattcagatactctgtacatcggcagcattgctggcaggcggatattacctgcagcggaaacagaaaaatctgatagaagaaaccgttcccggaatggtggaagcggaagtgacaagcgaagctgatttttataaaaatatggacaatgtctatggccttctgaacgtggagcagatagaaatggagttcggctacagcctgattcccctggcggatgaaagcaacggcgggaatttcatagaccgtgtggtcatgttccgtaagcagatggcgctggaaatgggttttgtcatcccttccgtccggatcaaggacagcgggcagctcaatccgaatcagtacagcatcctgttaaaaggagaagaagtggcaagaggagatatcctcatggatcatttcctggcgctttctcccggcccggatgcggatgatatcccgggaatcgataccatagacccggcattccacatccctgccaaatggatcagcgaggataggaaaatacaggcggaaatggcaggctataccctgatcgatccggcttcggtagtcatcacacatctgtcggaggtaatcaaagaacatctttacgaactgctcaaccgtcaggaggtcaacaacctgctggaaaacctgaaaaagaccaatgcgagcattgtggaggacacaatccccggcgttatcagtccgggcagcctgcagaaggtgctggcaaatctgcttagagaaggcattcccatccgtgatatggaaacgatcattgaaacggtgggcgattacggaaaacagatcaaagatacggatatgctcacggaatacgtgcgccaggcgctgaaacgcaccatttcccaccgcttttccgaagcaggacagatgaaggtgatcagcctggatgaaaaaatcgagaacatgctcatggcctccgtgaaaaagatggaaacaggctcctatctggccctggatccctcctccatacaaagcatcattaccgcttccaccggggaaatcaataaaatcaaggatctggttaatgttccgattgtgctgacctcacccgtggtgcggatttactttaaaaagctgatagaccagttttaccccaatgttacggtgctgtcattcagtgaaatagataataatatccagattcaggcgcttggaaatatcgtcctgacgtagaaaggaaaaaaaggttggcggagttgacggaaacccgggaagcccggatgctgaaggaataccagcagaccggcagcccggagttaagagaaaaactgataaatgaatatatccaccttgtgcgttccgccgcggtgcagatgagaggcatggcatccggctatgcacaggaagaagatttggtgaaccagggcgtgcttgccctgatggattgtctggaacgatacgatgagacaaggggcgcgaagtttgaaacctttgcattcctgcgggtaagaggttcgctgatagattttgtacgcagccaggactgggtgcctcatcgggcccgttccctgcagagacatatcgaagaagccttccggcagctggcaaatgaaaaaatgagggaaccggatgcggcggaggtagccgcttacatgggacttcccacagaaaaaattgagagccacctgcagtatatggatcgtgcctccatcctttcttttgaagggatgatgcaggaggcgcaggaaaatgccagccggatggaaccggaaagcccggatctttctttaaggccggaagaaagctactgccggcaggagcttacggaagtgctggcccgggctgtggaggggcttacggaaaaagaacggctggtcatcaccctttactattatgaagaattaaaatatgcggatatcgcccgggttctggacgtagtggaatcccgcgtatgccagatccatacgaaggctgtcaaaaaactcagagacagtctgcgggaatatatggaaggttaggaggaaaccgatgttatcaggtttttatacggcggcttcaggcgtgctcaccaatcagagggcactgaatctgaacgccaataatatggcaaatgttaagacccccggttatagggaacaaagactgattaaaaccacctttgaagaagaattcctgcgtatgcagggaggaaaatccacttccatgggaagcggatcactcatgacggcggccgcatcccaggcggtttcctttaaacccggagacctgaccgagaccggaggcgcctatgatctggcccttggcggagacggctatttcgtcatccagggagagaacggagagtatctgacccggaacggcaatttccgcatggatgccgaaggatatctgagcctgaacggaataggaaggctcatgggagaaaatggtcccgtccgtcccggaaatgaaggctttcaggtagatgaacagggtaccttccggaacggaaagggagatatcctgggaacgctcagaatcgtgatgccggatatacccgaaaatatgcagttctatgaaaacggaatgttccaggcgggaaatgcacagcttcttcccgtgaataccgccgtgattcagggcagcctggagggctccaacgtggacttgagcgcggaaatgaccagaaccatggaaatccagcgcgcgtttcagtcctgcagcaaggcgcttaccatcatcgaccagatgaaccagaagacggtttcggaaatcggaaaaatctgagggtaaaaagcgctgcgcagaattcacgcgcgcatacaccctgcatacggcgaagcgtgcagatgggagaaaagaaagatgaatacagcattttatacggcggtttccgggatgaggacctttcagtccgccctggatatcaccgccaataacatggcaaatgtgaacactacggcttacaaggcggaaagaggagcctttcaggatctgctgtacacgcagatggacgtcaaatccggagagcttcttaccggacacggcgtaaaaatgagtgatgtgcagccggttttcatccagggggcatttgaaaaaagcggccagccgctggactttgccattacaggagacggctttttcgctgtggaaaaaggaaacggaggaacccagccgctgtataccagggatggttccttcaaaatatccgtatcggaggagggggacttcctggctaccagggacggatattttgtgctggacggagacggaaagcgcatccagctgaccaaaaaggttgtgaaagataaagacggcaaggagcaggccaccaatcagctggacctggacggcctgaataaaaaaataggcctgtttacctgtgataatccggaaggactcgtgcatatgggtaataacagataccgttccggagagttttccggccagtggacagcggttaaggaacagacaaacagcagccgtatcgtatccggagcgcttgaactgtccggtaccgagctctcttcggaaatggtgaatgtcattgaagcccaacgcgcattccagctgaacggaaggattgtgacaactgcggatcagatcgaagagatcatcaataatctgagataagtgatgcaaaagggcggaaaacaggcatgtcagccggtaaaggagagttcccatgaaggaaaaaagtctgctttataatctgtttatgaaataccttggcgaagatggagaggaagaagaagcaaagcaggaaacctctctgtctgcccacggggatcaggaaaaagaggaacatatgcatgacggcgaagaagtaaatcctcagaagacagatgaggaactttccgaacaaccggatatatcacataaaacggatccggaggctttgattgaaaccgtagaagactggaatgaagcggagctgctgaagcagaaggaactggacgcaagaagccggggcgcggaagaaccggattctgaggagattcccgcagaaccggaagaagagactgtcctttccagggacgcctccctggaacttactgtaacggatgataaaatggaagcgacgatgatggtatgggaaccggaaggggacggggcggatataacagaggaagcccttcacaaagcccttcaggataagcatatcacctacggaattgatgaggaaaaaatccgtgacatcgcggaacacaaacgctatcgtcagctgtttgtcattgcctcgggaaagcctgcgaaggacggaaccagcgggaaaataaaggattttttcccgagacaggtacagctgaaatatgccaccaaacaaaatgggggcattgattttaaaaacatgaacctgatccataatgtaaaggaaggcgatgtggtatgtcagatcactcgacccacagacccggaagacggcatgaatatttacggacagccggtccggggcagacagggcgctatgccggccatcccccagggaaaaaacatcacctataacgaggacggcacacagcttgtggcggcctgcgagggaaatctaaccttccgcagcggccgtttccatgtggaaaaggtattcgaagtggccggaaatgtggataattccattggaaatattaatttcagcggcagcgtatttatccagggagatgtatttgagggttatgaagtacgcgcaaaagggaatattacggttatgggaatggtggagggagccgcactcatcgcgggcggagatatccagctccagaaaggaatgcgcggcatgcattgcggcgtcctggaagcgggaggcgatatcaccgccaaattcctggaggactgtaccattcacgccggcagcaatatccaggcggaatatatcatcaactcccaggttgcctgtgaaaacaatctcacccttgtgggacgcaggggagcctttatcgggggaagctgttccgtatacaatgaaatgaatgtcaaagcggtaggggcggcgagccacatcaccacctccgtcacgctgggagccaccccgcagcttattgcggaagcggaaaaagcggcccgggaaatccgggaagtatccgaacagatggaagaaaaccgcaaaaatacggcatggcttaccgaaaagcagaaccggggaagcctgacgcccgtccagcagcagagactgagcgccctgaacctggaagcatcggtaaacaaactcaaacagcgtcagctgcagagcaaagcggcccagctggcaaaacaaatccgggaggtgggaaggacccgcctccaggcggatgaggtttatcccgggacgattatctgcatcggggattccaggcttgtggttatggataaagaagacagcgtgagctattactatctggacggagaaatccgcaagggcatgcgctgacagaaataaaatgaggggaaacgggaaatatggctgacatcttgaaggtaacatctccggtaatcggcaagaacatcgtccaacagaataaaaacgtaacagacccttccatcccctttgatctccaggaaatcagccacatcgcaagaaatcccaacagcagcgccctcctttcccagcataacatcttccagcgggatgcgggcgccgccacactgatgaatctgctcaaggatccggatgtgaccgtgaactacctgaaaaacatcactatgcttgaagaaatcatcagccttctgcccgtgaacaacaacacagtaacggaagaaatccagcagcttttccaggctcttttgatccatcccgattccattgtggatgagatgatgcgccaggaatactcctccaccctttttaaaggcccgctttttgatttcctgcgctccctggtcaaagaaaatcccgagcttcgcgcagaaaccgcagaattactgaaagcgatcaattccatcctttcaagaaaagatgcggaagactccgccgccaatggcttttccttccttgcggaacagctctccgccagcaaaaacatggcgccccgcctccgggaactggcggcaggcttccgccaggatgacggaacccttttccaggaactcaaattacaggcccaggcccttcttaaggaaatggaggggagcatcctgtataccccccaggcggcccgtgtagtgccgaacatcatctataatctttcccgctaccgggaaaatgaagcctttctccaggaagccctgttcggccttctggtcaggatgaacagcagagaggccaaggatcagctgcgtatgcttgtgaaggaatatatagaacaattcccgaaagccgacaacagcctgacacgctcccacgtagtggataccctggcggaaatcattgccaaacaggataaggaaagcggcatgcagagcttaaacggcgaccgcatcgaaaaaatcctcaccagccttctttcctccccctgcaattacacgcccctcctgcattttgtcatacctgtggacttccagggaatgaaagccttctccgaactgtggatcgatcctgacgaccgggaaacttcggcaaaggacggcggagacggcagccatatccacatcctgattacttttgacattgaggggatcggacagctggaagcggaattcatggtgagcggaaaaaccatcaattttcttctgctctgccccaaaggctacgtaaaacttttttcaggccttctccccgaatttaagaagattgcggaacaaaaaggataccagatgagcgatgccaaggtggagaagctggagcatatccgctctctgatggatgtatttaaaaccctgccctacaggaggaccggcgtagatgtcaaaatataagaaaaataaagccgccgccctcaaatacaacatggaagaggatacggccccggtggtcatagcctccggttacggccccatggccgaaaaaattatagatattgccgagcagaaaggcattcctgtttttaaagatgacagcgccgcctcccttttgtgcatgctggacgtgggaaccaacataccggtggagctgtacgaggtgatagcggctatttatggaaaactgatggaagcttctgccaaaacccatgggaattctccggccgtgggaaaaactccggcggcaggaaaatctccaaccgcaggaaaatcaccaaccgcaggaaaaacatccgcttccgcagaatataagacccaaaatgcagaggccggcccggaaaaaagaacgacacgcccctctctcagggacggactcgtatctgccgggaaaaaagaaacggagaaagacagcacagaaactaagtgaggggaaacaacagcatgattgatctgtcggaaggatatataggatcttcctgtgtggtgaaagccaagaacaacgatttgttgatgatgggtaccctgcacaggattaagaccagctttatagatatcagcagtaccaggaatgaacttcctgtaataagctataacctctttgtcaaggtggaagtctacaatgcgcggctgggattccgcgtgcttataggcagagtctatatttccaatcaggaattgattcggattatagacttaaacgaagctaccaacgatgaacgccgcgagtacttccgaatcagtacgagacgtgacggcattatctttaacctcacccatccgctgccggacgggacaataaaagaataccaggatttcaaggtttccctcgtggatatcagcctgggcggcctgatgttcaggacaaaggaagtgctgggagtgggagaaaccttcagcattgtaatccccgccatgaaagaaaacatgctctatgaatgcaccatccgcagaagtgtggagaaaccggaaaactacatcggttacggctgcgaattcagtgagatgaccaatctgcaggaggatatcctctaccgctatattttacggtgccagaacgaacagcttaaaagaatacgttgatcagaaagaaaaaactgatcaggaagggaaagaaacgtgagcaggaaaaagccggaagaccggagagtggtcaggaccagaaggacggtgatttataccttccttctgatcctgatttttatgtatatatccgcccatgcccagttggaagaagagcgggcgcaggcactgcaggcggagacgttggaaacgggaaatgctgcgcaggccgggcttgctgccgggcaggaagaaaacggagaacatgcgacggagcaggagcagggagccaggaaggcggaaagccaggaaggattgatccttaatcccgaagatatgtggtgcctgatcctgaccaatgcccaatatcctatcccggaagactatcttccagttctgaaggaggttcccggacagggacagtccgtagacgaacgcatttacgatccgcttatggagatgctttcggatatgaaggaacagggattatcccctgttgtctgttccggttacaggactcttgataagcaggaaatgctgtttaaccggaaggtttccgcctatgtgaagcagggctattccatggaagaagccaatcagatggcccgcaggctgctttctattccaggatccggtgaacattgcctcggcctggcagtggatatttactgcgaatcctatcagaagctggaagctggttttgctgagaccaaagagggaaaatggctgcgggaacattgttgggattacgggtttatcctgcgttatgaccaggggaaagaagaactgacagggattgattatgaaccctggcatttcagatatgtggggaaagcggccgcccagtatctgaaggagacagggatgtgcctggaggaattttatattgaggaaagtctgtatgggtgatgtggtgaagcgggtacaactgtgatttgaaaaataggtataatatgtaaaatagcacaaaatgaaattcactttttgtgaaatatcacgataaagaataaaaaattaggtacgatcacttaggtagaacagcagggatagtaagttcctcctgtttggtgccgggcaagggcccgtccggtactgcttaataaaataaaaatgagggaaaaggatttcccgaaggaattattacatggaggtaatagtatgagaattcaacacaacattatggcattaaattcccacagacagctgggaaacaacaacagcgcagtatctaaatctttggagaagttatcctccggttacagaatcaaccgcgcgggtgatgatgcagcggggctggctatttccgagaagatgagagctcagattaaaggtctgaccgcagcttccgataactcccaggatgcgatttccttagtacagacagctgaaggcggattgcaggaagttcattccatgctgaaccgtatgcaggaactggctaccaaatcttccaatggtacttatacggatgatgttgaccgtaaggctctgcaggatgaagttagtgctttgaaggatgaaattaatcgtattgctgatagtactaactttaatgggattaacctgttggatgggtctatgggtgttggaactactggggcaacagatactcttgctcaaggtgcggctgctggacaattgaaaaccaatgctgtaaatgtatcatttgcggctcctgaaggatataaattgaaaattgcatcaggggcagataaggctgctgcaacagctacatttgatgaagcaactaaaacaattacccttactcttgaatcaactgcaggtaaagtaacaacacaaaaagatattgataaattattgcagggagtagctttaccttcagaggcaatgggaaaagttaaagtaactattgataatgatattgagtttgcaacacctggtgccgctgctaatattaaaacacttacttcggtagccgcaaagcaggcaactgcgacagatacaaatacaggtataactgtatcatcgactaaggccggagttaatacgcacaaacttactattaataatacaacaactgaggcgactggagcgaaagcattagtaagtggtgatgctacacttgcattagaggctggaaaatcatacacatcaagtgatattaataagatgctagcagatgctggtgtagaaatgcgtatggattttgatggcagcaaaacaggtgctgaaatttatgcaggcaaatcagcagctgctgatcatacctttactttgggggatactgtagcgggtgctggtctttcagcaggcggtggtattgaacttcaaattggagatactaatgatgcatggaatcagttagaactttctattgatgatatgcatgtttcttccttaggtataggtgatattgatattagcacaagacctggtgcttctgctgcaatcagcaaaatcaaagatgccatcaatcaggtttccaccagccgcggtaagttaggtgccatccagaaccgtctggagcataccatcaacaaccttggtgtaacaaccgaaaatatcacagcggcggaatcccgtatccgtgacgttgatatggcaaaagaaatgatggaattcacaaagaacagtgttcttatgcagtccgcacaggcaatgctggctcaggcaaatcagcagcctcagtccatcttacagttattacagtaattctcataaaccaattggaaggccgcagactcctccgggagcgcggccttcttttttattatgaaataaataataaatcttcatatcatagctgcttttatgtttatacttttttaatgattcaaaagtaagatcctcatttcatttttcgaaaaattatgatataaataatttatctggttatcaatatcttatattttctcaggctgtatcagccattcattcatttttagaatctttttatatccaaatgaattgcttttttgttggtatatcactataataatccatataaagcacatatcttttggattaaccatcaattcataaggaggtattgtgcttatatggcaaacgaaaaggacgcggtaataaagaaattcctggagaagcctgagaatttcagtgatttatttaatggctctctctttcagggaaagcaggtgctgaaggcagatatgctgggtgatttaccgggagaatctatgatttctttctcagataaagaaggaaaaaaggtatcggccagacggtaccgtgacataatccgtaaagcatccggccgaacaacgtatgcagttttcgcagtggaagggcaggaaaaaacacattatgccatgccggtcagggaaatggtttatgatgccttgaattatgcaacgcaggtaaaagaaatttccgacaggcaccggagagataaggattatcgtgacagttcggaatttttgtccggtttgctgcgggaagacaggcttgcgccggtgattaccatttgcctgtattatgggacaggggaatgggaagggccgagggagctttatgaccttttggatatcccggaagaatatgaagatatgaaaccgtttatgtccaattacaaagtgaatctggtacagccaaccgatgtggatccggaaaatttcaggacagatttaaagcttattttttcactgctggcaatgtcatcagatggaatgggtatgaggaaatacatacaggaacattcggaagagttcagtcatattccttatgaaacatatgattgtctcagagagctgcttcacgtggataagtggtggaaggcagaaagtaaaaaagagaaaggggaagtggatatgtgcagggcattggaagagattgctgagatggcaaggcaggaaggcaagacggaaggccgggaaaatggagaacaaataatgctgatcaagttcgtaacaaggaaacttctgaatggaaaacaggaagaagaaattgctcttgaattggatgaggacagagataccgtgactcggatttgccgggcggcagcgaagtttgcgccggagtatgacagtgaagcaatatatcgtgaaatgaaaaagttataaaatatgagtcaggaactgaagtgagccacggctaatgccgcggctccttttttacaaccaggattgcctgaacaagcgctcccgttacttcagatgcatatttttcttccgcttccttctgcttttgttcccggttgccttcgattaccgtatagtgaggggcaaggcggtttaaagcaagggcggcaatatcttttttacatttatcacaccggcagcagttaaaacgctgaatggtggagtccaggcgggtaaggaccagttcttccatcaggttcacaagtacggaatccttattttcccgcatctgtacaggtgtggtgagggagcggcgcagtgcatcggccatacctgcggaagtaggggaaggggcgctgtccatattactaacggaggaaggtgcctctgtatgaaccggctgggaacgggtagaggaaggcatgattttgcggtacatgatttccttgtctatttcagctttgcttttagccatgcctacagccccctttcctgaagttcatccgtcagcgttttataatcctgtacggcattgcaggaaggggcatagtccagtacggactgctggatggactgtgcttcccgcagagctacgctttccctgataaaagtatccagaacagggatggaaaagtcctgggcgatcatattcaaggctcctttgacctcccggctgaaacgggtcttgggattgtgtttggtgagaaaaactcccagaatctgcagatccgggttgcagaaattttttaccctggaaacggtctccgaaagctgggtgagtccctggaggctgaatatatctgacatcatgggcaccaggacaaaatccgacgcagtgaaggcattgacggtcagaatacccagggcaggaggggaatcgataaaaatgtaatcataaacctgctgcagcggctccaacgccctttgcagcagatattccctctgcgtgccggtaaattccagttcgatggaactgagcagtatattggaaggtatgatatcaacaagcccggttttctgaatggcaaaacggggtttgacttcctccttcagaacttcataaatagtcgccgtgccgtcggtatcggcccctgtgctgaaactcaggtttccctggggatccaggtcaaccgcaagaactttatatcctctttcccgaaaaatgagtgcgagggcgttagcagtggtagtttttcccacaccgcctttctggttggaaagaacgatggttttagccataagtaaagtaacctccgtgtgttgtgtggtgtggtgcggtaacaatttatacatggttatcatgcggtttttctctgtgtaccttgggagtccggaggacaggaaaaagtgtcggaggaaccccgaaagcgtagatgcaaagagaaaaaccgcacctcaatcacattatattataacaacaaacagcaggggaaacaactatccaaatttttttgtaaaatagctaaagatatacaactgatgtacgacaatacagttgacagagtaaataccgggaaagggtgctgaaaatggatataaagataacaggcaaatatgcaatatatcagagtgccgtgagcagcggcaggaaactggaaaaaaatacagctgtcccggccggaagtgcaggcgggaagggcgatgagatctgtatcagcagcgatgctgtgaagaagcaggaggcatcggtttattcttccgcagtgagttccgctcttaaggaaccggcttcggaggaacggattgcgcagctgaagcagcagatcggggatggcacttatcagatatccgccgagctggttgctaagaaactgatgtcaggtttataagaaaaggcggccgatgtggaagaaatatttgtttttttaacagagtatacggaattcctggaaaaaatggaagtgacccagcaggaaaagctggatttactgctatccggggatctgaagaaaatagaacagagcatcatggtacagcaggcgatggataagcagctggaaaatctggaacaggccaggatgcgtctttttcaggagcatggagtggaagggaaaaccttccgtgagctcatacctcttcagccggaggccaggaatggagagggctcttcctcctgcaggcaggactggcagctgctttatgacaggctgcagaaggcgattgacaacatccggtactataacaaaaaatcacaggattttgcccgctcggaactgataaaagcgggatccgatgcagggactgtggatccgtccagcggggtttaccatccggattacggcggaagaaagaatatgtttagtaagaaaatatagcggttgtcagatacggctgcagcatatacagaaagcaggggcacaggggatgagaccgacattcatggggctggaaacagccaaaagaggcctgatggtgaatcagaaggctattgatattgtaggaaacaacattacgaacatgcagaccaagggctataccaggcagcggctggatacggtgagcgtgcaggtatacggaggaatgggcggttttcagacaagctccattccgctggcgggccagggcgttgacatgctgggagtggcacagataaggaatccctatctggacagtaagttccgggagcagtacggggaagtgggttattatgatcagagaaccgctatcatgcaggagctggaaggaatcatcagcgatccggaaacagaagggaccggactgaaggatgcccttaccatcctttcccaggcactggcggatttcggggagcagccctatcaggaaacaaatgccaacatcacactgaatgcggtgaagggcattacccatatattgaatgaatacgacagcaagcttaaaaatgccatgcaggaacagaaggatgatcttgcggcatcagtgaaggatatcaacggaaaactgaaacagctggcggaactgaataaatccatcgtccatgaggtattcgtgagtgacgatttggacggtgtgagctatggcccgaatgatctgctggatcagagaaatgtcattctggacgatttgtcccgctatggcaatgtttccgttacggaaggcggagacggacggattcaggtgaaattcaacggcaaaaccgtggtggattccagcggaaaccagttcaccagtgatgaacttctcatcgggccggatggagtgacgcttacctggaacagtgacaattcaggcatgcatttggagaatggcgcgctgaaggcttatacggatgtgattacggggaatgcgccgggcaatgcgggaattccttattatcagcagaagctggatgatttcgcggcggctttcggtgaactcatgaataatacaatccatgaggatgacgggacagcggtgttcaagactttgatcgaggcagagggcggaggagcgctgacggcgggaaatatatcggtcagtaccgcatgggcggaagacccgtcctatgttatccgggatcagaatccggacggaacgcttgacaataccgatatcatgaagctcaaggccggtctgacagaggaacggacctttgggaaggagtataagtattccggtaatttcagcggattcattaccaattatacggataccctgggcagtgatatcaaaacgaccaaggcaaggctgaacgcatcgcttgccattgcggaaagtgtggaaaaagatcgccagggagtgtcaggggtatctcttaatgaagagggtatcaacctgatgacttataacaaagcgtatcaggcactgggaaggctcatgaccaccatggatgagcagcttgatatgataatcaatcagatgggcatggtgggacgctgataatggcagagcgcgccccgggcgcgggatgggagtcggaatgagaattacggaaagcatgctgacaggatcctataccaggaaccttcagcgcaatatcagcaatctggcacagtccaatctgaagctttcctccgaacgggaatacaatcatgtatcggaggatccggcaagggcggcaaaggcttttgcggtaagggatcagattgctttaagcgaagaacatataagaacggtaaaaagcgccatgggggaactggatacggcggataaaaatatccagtccattaactctatcctccagacggtttttgaaaaagccaccaaggcaggcggtgtgacaaatcaggaaaacctgaatgccattgcggaggagctgcatggcctgaatgaagaaatcctccagaccatgaatgccagatacggagacaaatatcttttttccggatccggtaatgaggaagcgccgtttaccgtggatggcgggagactttttttcaacggaaaagctgtggatgattatgataaggacgatccggatacctattttgacaacaacaaggaagtttatctggatgtgggcttcggtgcttatggttccggtgcggtaaatgccaaaaccggtgtgaagatatccacctcaggtgtggatgtgctcggatatggaacaaaggacggccagcccaataatatatacagcctgatatcccagatagaggggcagctgcgcagcggaaacactaaggatgctatggatacgctggagcatttgaaggataagcagaataatatttccattgccactgcggaaatcggcacgagggagactcttctggacagggcgcaggaccggcttgagggcggcctggtgaatctgaaggagaggcagaaggatctggaagcagtggatttggcgggggaatccattaataataaggcgtatgaagcagcctggatggttacgcttcagctgggaagcagcctgattcctccatctatttttgattttatgaagtagtaagtggataacaggaggtcattcaaatgaatgtgcttaaaataaccacaacacccatcaagctttccatgtcgtcccagaaagcccgtctggaaagccatcttccggaaccggagctgggaattatccgtaccccgtcccgtctgaatatgaaatcggaaaatatcaaggtaaatattgatacttcggcggccagggacaatctgggtttcaagacggcccgttcgctgaaccgggatgcggcggttttcggaaagcaggcggcagcggatgccacagggcgttatgcccagatgggcaatcagatgatgcagatccaaaaaggggtgacgattcccgaaattgtacagaaccagatgatggctcagacaaaggttacgacaggctttgaattccttcctgccgtagggccggatatcagctgggatccgggaagccttgccatagattataccccttcccggatagaatttgatccgcagccggatatgcaggatgcggtttatgttcccggagagctgaatattaatgtggagcagtatcccaaggtggagatcgaatatgtgggagagccgatgtatgtccctcccagcgcgagtcctgagtatgaggaaagagacggactttcataaagaggcgctcggaaggaatggcttacaggaggaataggcagttgaaaatagaaacaagggattttggcatcattgatgtggaagaagagaatatcattacctttaagcagccggttttcgggtttgaggattatacccagttcgttctcgtgacggattccaacatgggaaacgggatatgctggctgcagtccatagaacagaagggaatctgttttatcatgcttaatcctctggagatctgtccggattacgctccggcagtcatgcaggatgtgcttttcaccctgcaggcggtgcctaaggatgacctggactgctgggtgatcgcagtgataggagataccttctgtgagtctacggtgaatctgaaaagtccgattatcataaaccataaaaccaatctgggaatgcaggtgattctcgatcaggattacccgatccgccagccgattttcgattcgaaaggtggtggggtatcatgctgatcctgtcccggaaaaaaggagaatccattataatcggagaagatattgagatttttgtggcagatgtgaaaggggataaggtccgtcttggcatatctgctccggaggatatgaagatatcccgaaaagaactctatctgactgtggaaaacaataaagaagcatcggataaagtggatctgctaaaggtgttccagctgtcccgcagcctgtatgcgcagcagggaacggataaagcaaaaggaaaggacgaaccggatgcagatacagacaataaataagcttaaggaactgacagataacagaaaacagctttttacagaatatctgacaatcacgcagaagcttactgacctgaaggaagaggacgtggaacagattacggcaggaatggaacagagagcagcgctggccgagcagatcgatgacctgggaatgcagagcaggaaagtttgccgggtggatggaggagaagagcatctgactgaaattctgcagtgccgggcggatttttctttgttgagcgaagaggaaaaagaactgttttccctgtgccagtccgttaaccggattctgttagagattcaggatcaggaggtcctggtgcacaggaattttgaggacattcggaataaactccaggaatccatacacaggaacaatacaggggcgaaattcgcgggttatctgaatcatatgaattacggagcatccaagggtgtcctgtatgacagtaaaaagtaggaggcagtatggcatcttcaattaatacagtgagcgggaaccgggttgcaggcctggcttccgggatggataccgaaagtatagtggaaaaaatgctttccggcacgcagtccaagatcgataaacagacaggcttaaagcagcagctggaatggaaacaggaaatggtaaggggaattataacggatatcaattccttccatgataaatacttttccttctacagcagcgccaataccaacctgctgagcaatgctttttacaatacaatgaatgcggcgagcagcaccagtgcgataaaagtgatatccgctgcttccaatgcagcagggaaggtgaccatagatagcatcgaccagctggcatctgcgtgtacggtgaaatcaggagaccgggtgagcggcgaactgaaaggtacggttatcgatcccggtcagtttacggaagagtcctattcctttgaaatgactctggatggcgtcaacaggacaatatcctttaataaaggaacgaatgcgaacgaaacagaggcgcttaaggaaacggtaaataatctgaatgacagcatgtacagggctttcggcactgccgcaggatttcaattggatacaacacagccgggcggtcccaggctgaatctaacccaattggtatgggatgaaacacagaatggcggtcagggcggagcagtaccgaaaagtaatggttcaggcggttatgttcctgtggatacctccagaaagctgtatatggaaaatacgcaggggaaaacagcggtacttccccttctgggatttaaaaatgaagcttccaataagctcgactataataccagcctggattccctcccgctggcagagcctcttcagggaaaagagttttcctttaagattaacggtgttgttatagatgggataacaagttccagtacattgggcgatgtaatcagtaaaataaatacatcagaagcaggggtaaaggtttcctattcttccatagaagataagtttattatggaatccaagaccaccggagatatttccaatattctcatggaacagacttcagggaatctgcttacagtcatgttcggtacaaaaagtgccgatacagtgacaggaagtctggacggagtgaagagtagtaaggatctggtttctgtaaatacaattgatgaaatgatgaaaaatgcagtgctgggcggtgtaaacggcggaaccccgcatatcttttcactgaatgttgacggaaaagatgtggatatcatagttaagagagaattaaccgcagacagtacggactggaatatgagtgagctggctgacgaaatcaacagacagctggaagaaaaattcggggcaggcgaaattgttttgagcgttgatgatccgaattcaccgaccagagctacagtctcttccgcaaaccatctggtcagcttcaatgatgaaaatctgaacagggatatcacttccatgctgggctttacgacggcgaatacgcagaaggccggtatgcagtccactctgggtgagttgggttttcacggaaaaataacatttaccggaacgcagcctgatgcttccggttcgtccgctatgcaatctgtcaccatagattttgataatgttgacacgcaaggccagacggtagagtggctggtaaatcaggtacggactgcaggagtggaactcacgtttgacaatggagcagttcagattggttctgccagcagtgtgacaggggatggagaaggaaagaaaatccttaattctctgtttggaacagacagtctcacctttggcacggcaggcagcgcagccgtggtaacggaagggcaaaatgcaaagtttgtggtaaacggacaggtcgttgaaaggaacaccaataccttcgaattagagggcattacactggaactgacagaaaaatccaccggcccaattaccttgactacgactaaggatactgataaaatagtagaagggtttaagagctttgtcgaagactataataagctgattgaacagctgaatgaccgcatcaatgaaagcgctacatataagaaatatgcccctctgacagaggaacagagaaagtccatgagtgaccgggaagtggagctttgggaagaaaaagccaaagagggtctgctcagaaacgattccaatatcagttctcttctgagtgatatgagaacggcgctgtaccagtctgtggacggtgctggcctggctctgtatgatatgggaattgagacttcggacagctggagggataacggaaaactgattctggatgagagcaagctgaatgcggcgataagcaccaatctggacggtgtgaagaagctgatgacggataaggaacacggaataggtgtactgctggacaatgcggtgaaagcggcggccaatgtgagtacgggcagtccgggaagccttgtttcctatgcgggaacgaaagcggtcctcaccacggacaacagcctctatcagcagcttaagagcgtgagtaatacgctggcgaatctgaacattaggtatgagtcggaacggacgcgttattggaatcagtttacggcaatggaacaggcgatttccaatctgaacaatcagagttcctggctgacacagcagttctcatcaggcagttgatgaaaccggtaggaaaaggagcggcaaaatgcagaacccatatgaaaagtacagacagcagtcggtcatgaccatgacacagggagatatgatttccctcttatattcggagcttggcgaccgtcttggaaaagggctgatttgtctggaaaataaggattacgaaggctgtaacacagcgtttaaaaaagcgcaggaaattttgacacatctcactgcgacactggatcgcaaatatgaggtggccgataagctggcggctctgtatgatttctttaaataccaaatcatacagtccaatatacggaaggaagccgggccgatagaggaaatcctgccgatgataaaggaattacaggaagtatttgtacaggcggataagcaggtgcggatagagaacagcgtcggatagaagacgcgcagagggggatacagaggatggctttttgggaagacccgtcagtaaaggcattgagcagcggcatggatgcgctttggcagaagcagcaggtaatcagccataatattgctaatgtggagacgccgggatataaggcaaagcatgtggaatttaaagaggtactgaaaaagacagaggacgggggagaacccgtcaaagagtacaggacagtagtgtctgtggacgagtccacacaggccagggccgatgggaacaatgtccaggtggagtctgaagagcttgagctttggaagacctatgtggagtactccacactgacgagccgcatgtcaaagaaattttcctctctccggtatgtgatcaacaatgccggtaaataacggaatacgaaggagcgaatgatgggatatctggattcattgaatataaccggttccgcactgacggcggaacggttccgtacggatgtcatactgcagaatatggctaaccagaacactaccaggacggaagacggcgggccttaccgcaggaagcaggtagtgcttcgtgaaaattccatgagctttgaaacacagcttgataaagcggtgaaaaagacagacggaggcggagtatacgcggagcaggtggtggagagcgaaaatccctttgtaccggtatacgatccggaacatccggatgcggatgcggacggttatgttatgatgcccaatgtgaacagcgcggaggaaatggtggatttgatggcggcgacaagagcctatgaagccaacattacggcgctgaacattgccaagagcatggcgatgaaggcactggagatcggaaaataacagatcctgcagggaaaaataatatgaagagaagaaaagaagaagagggcggcggccaggagtggctgaatacctacgcggatatgatcactctggtactgaccttcttcgttttgttgtacagtatttccaatgtgaatataactaaactggaacagatcgcggcggccatgcagaaaaagctgggcatggaacaggcggttagcctggatgaagtaccggaggatatcaaatatcccacaatcggagaagaaacaggcggcgtccctgacagttcttctacggaaagcattcagaagatggcggaggaactccgggaatattttgcgaattccaatattgatgcgcagacgagcagcagcgatgatgtgatttacatacgttttaagaatgatctcctgttcgggccggacagcgcacagctgcgtgaggaaagtgtttccatgctggattccctggggaatatgctgatggaaaaagaggatgaaatccttgcggtttatattaacggccataccgcccaggcagcgggctctcccgtcaatgacagggtgttatcttccatgcgggctgacaatgtggcgatctatctggaggatcacgtgggcttcgatccgaagaagctcatatgcagggggtacggaaagtattatcccattgcggataacagcacaaaagaagggcgggagctgaaccgccgtgtggatattattattctcggaaatgattttaaaatgtccgatgtggacgaaaggcagcaggaggtaatcgatcctctggcgcctgtcacactgccggaattagagaaagggcaggacaaatgataaaggcatacgactttaaatcccctaaaaaatttacaaaagaaagaatgagcaccgtggaaaatctgtacgacagtttttcacggtctcttgcaccttacctgaccggactgcttcagtcctattgtgaaatctccattaacgggatccaggaaatgcggtttcaggaatacagtgcggagctggatgaccgttctttgttcggccttattacccttgcgccggaaaataaggattacagcgatgctcccatgatttttgaaatggatacctctcttggatttttcatgattgaaagactgctgggaggggccggtacggaatatgagctgcaccgggattttacggatattgaaaaggcgatgctgcactatcttctggaaaagatcaccggctttatcggggatgcctggggcggctacatggacgcggaagtgacgctcacaggccttcagaccaatcctcatctgcttcagctgggggcggcagaggatgtggtcattctggtggagttgggtattgtggtgaatgagctgaaggcgaagcttcatatcgttatgcctgcgcccaacgtggaagagctgacctcccgtttcggatacaagtttgccatgaaccgtaagaataaggatgaggcaaaggcggcggaacgtcagaaatacattgagaaaaatcttctggatgccgatgtggaaatgcgggcggtgcttcatgaattttatctggacgcccaggatatccttcagcttcagccgggggatgtggtacccatcggtaaaaatatggcgagtgatatccaggtttacgtggaagatatgccctgctttgaagcgaagcccgggcataccagcatgcataaagccgtgcgtatcagtaaggtgctgtaaagacaggcggagaaacaggagagaatcatgattagtgcggatagggatgcgatgcgggagctgcttgagctggcggctgttcctgcgcaaaaaacgctgaattcattgatgggcggtgcggccgttacattgaaagaaataaaggaagtgtctttggaagctttggcagagaggcttccacatttttccatggtagtggaaggacgtgcattttctgaaaaagaagaggtgcgtatgctgtattttatggacagagaacaggcgcagcatctgataagcgcgatctgcggcctgccgcaggccggttcaggcgctatggatgaaatcgcgatcagtgcgttccgtgaagtgctttcccagtgcctggagacctcggtaacggaactcagaaattttcttgcgagggatatgcagcaggagctcggcagggcctatctgtccgattccgcaggaagtatggtaaaaactcccggaatgtggcaggaaggaagcattctcatgctggaataccggatcactctggagggagtgggggaattcaccctgttctgtgcggcctccatgcttttatttaatttattcggcatggaatacaaggctcagaaagcggccggaggcgggcgcagcccggcaataccggtgcgcagtgtgagtttcccggagttccgctatatgagcctggaggataccgtggatgaaatcggtgaagaccgggtacgtatcagagacatgagtctggatgtgtcggtgcggatcggggaaactgtctgcaaggtgcgcgatatcctggcgctgaagcccggccagatgatcgttctggataagcaggcgggcgcgcctgccgatgtggtggtgaaggatcggcttatagggaagggcgatgtccttgtaagcagtgataattttgcggtacggatcacggagatcgtaaataaagcggaataagagtagttgaaggagtattcatggtgatattaaagttgctgctgtatctgtttgtccttgtgctcgtggttttcctggcctactataccacgaagctggtgggaaaaagcgcagggggaaaacagctgggcaagagcatccatgtcctggaacggacaggcataggcagggacagctggcttatgattgtggaggttcaggggaaggtgatgcttctggggctttcgcctgcgggaattcagcaaatcagtgagctcgaagattatgtacggcccaaagaggatggagaaggagataaaagctttctggccatgctgacaaagcagatggaagagggacaggcagcttttcacagacaaaagaatgatcgggataaataaacaaatcgggaaaaagggacatccggcacaccggaccggatggaaggccgcaggagcgggatgtatgctgtctgtactggccgcatttttatatgcaggcagggtttatgcggcggaggtgtccatgaccttatctgatacgcagggaaatgccagagctttcgatacgatggatattctgattcttttcctgcttcttgctgttgtgccttctctgctggttatgatgaccagcttcaccaggattattatcgtcctgtcttttctgcggagtgccctgggaacccagcagtcgccgcccaaccagattctggtgggactggctctgtttctgaccctttttatcatgcagcccgttttttcccaggtgaatacacaggcttaccagccctataaagacgggacactgaccagggaagaagcgctggagctcgcgcaggatccgatgaaggaattcatgctcaaacagaccgaaaagaaaagcctggaactttttatggatatctctaaaacagaactgccggaaataaaagcaggagaaggcccggagcggtataaacagctggggctgacggtcatcgtcccttcttttattttaagcgaactgaataaggcctttaccatgggctttcttatattcatcccgtttctcattgtggatctggtggtgtccagcaccctgatgtccatgggtatggttatgcttccgccgaccatgatcgcgctgccttttaaaatcatgctgttcgtattggtggacggctgggatctggtaataaaaacgctggttgagggatttcattaaggaggcgcgctatgacgacagaacaggttatggaagtgatgaaggaagccatgctggtagcctttgagatggccgggccgcttctgattctgagtattattgtaggccttatcgtggcggtattccaggcggccacgcagattcatgagcagacgctgacctttgtgccgaagcttatagtcattgcggtggtcctgctggctacgggttcctggatgctgaataccttcgacggatttgtccagaggctttttgaaattatggcttccctgtaggtgatttttatatgttgacagagatagtggtttcccttaatctcttccttctggtttttgccaggctcggggcgatgatattccccagtccggtattcggcaggaagaacgttcccatgcggatcagggccggtcttgtactggcgctgactcttttgcttgtcccggtcctgaatgcgggcgcagtttccgcattgtcgggctttgacatggtggaaggtttggtgcgggaaatccttctgggactgatagttggttttgtattccagattttcttttttatgatctttgtggcgggggatatgctggataccgtattcggcctggccatgggaaaggtgatggatcccggcgggggtgtacaggtttcggtgctggggcagttcctgaatgtgttctttttcctgtacttctttgccacgggaagccaccggctgatgatcaagctgtttgcctattcctttgagctcattcctgcgggagcggcggctgtttccatggaaaaggccgggccgtttgtgctggccctttttcattccgtttttgtgctggctatccggctgaccctgccctttgtggcggcggaattcgtgctggaggcggcgatgggggtattgatgaaattaatccctcagatccatatttttgtgattaacctgcaggtgaaaatcatcgcgggtattctgctcatgatgctgtttgcggtgccgatgggacagtttatcgaccggtacatcgggacgctgtttgaggatgtacagaagctgcttctgcaattgtgaagaacagcgttacgaaaggcaggtggtgaacggtggcagcggatgaaaagaccgaaaaagccacacccaaacgaaaacaggacgaacgtaaaaagggtaatgtatttcagagcagcgatgtggccgccgttgcatctctgctggcggtgttcaacggtctgaaaatatttgcctcttttatgtataagagcatgtatcagggtgtgattctcttttttggatatgcacggatggaatatccggtcaattccgaaagccttcaggacaagctgattcaggccatgctcctgtttgcgcaggccgcgctgccgcttctgctgatagccggggtaacggcagtggctgtggcggctttgcagaccagaatggctttttccatggaaaccattaaattcaaggcgtaccgtatcagcccgctccaaggctttaaacgactgttcagcatccgttccgtggtggaattgctgaaagcgctgattaagattacggtgctgggctggatgatatattcctttttaagcagccggatgcatgaatttgtccgtctgatggatggtacggttatggatgccatttcttttgcgggaaatacggtgctgtccctggtgaacacggtgggtgtcgccttcctgtttctggcggcgtttgattatctgtatcagtggtgggattatgaaaagaacctgcgtatgagcaagcaagaaattaaggaagagtataaacaaacagaaggagatccccagatcaaagggaaaatccgggaaaaacagcgtcagatgtcttccaagcgtatgatgcagaatgtgccgaaggcggatgtgatcatccgtaaccctacacattttgcagtggctctggggtatgatccggaacggaataaggcgccggtggtgcttgccaagggagcggatcgggtggctttgaaaatcgtggaaatcggggaagccaacgacgtgtatatcatggaaaacagacccctggccaggggcctgtatgatgcggctgaaattgacatggagattcccggtgaattttaccaggccgtggcaggcgttctggcatttgtatacaagctgaaaaaggagaaatagccggtggatagcagtatggtggtattaaacggggtaagcaaggtttattccaatgggcagaaggctcttgacaacataaatctggatatcaggaaaggggaatttttattcctgtcaggaagcagcggagcagggaaaaccagcctgctggagcttctgctgaaggaggaggagccaacccgcggaatgatacaggtaaacgggatcgatctgggaaagctgaaggaacgccaagtataccgttaccgtcgtatgattgggatggttttccaggacttccgtctttttcccgattttaccgtatatgagaatgtcgcttttgcccagagggtgctggaggtacgccccaatgcgattaaaagccgcgtgcgcagcgttctggcccaggtggggctggaaagcaaggagcgctattatccgagccagctttccggcggggaaaaacagcgggcggcactggcgagggcaatagtgaacaaacctgtccttcttctggcggatgagcctacgggaaatctggatcacgaaaacggagaggacattatgcgtcttctgaacacgatcaatgaaacagggactactgtgctggtagtatcccataacagggatttggtacgttccatgaagaagagggaagttacgctgaaaaacggcaggattatcaaggacagtgacagagggggatttttatatgaactttaggaatttcatttatcttatccgtctcggtttgaaaaatgtatggaacaataaagtatatgcggctgctgcggtgatgtccatggcggcctgtattttcctgttcgggattttttatatcgcaatggtcaatattaacagcgctgtgcggaatgtggaaaaggatgtggctgtttccgttttttttgaggaagggatttccgaagaaagagtggaggagctgggagaagagatacggggacgggaagaagtgaccaataccgtatatatttcggaagacgaggcctgggacagcttccgcgaagacttccttgacagtgaagagctgagagaagggatttttgagggagataatcctctggcaggatgtgacagctatgaggtgtatattaatgacattagcaggcaggaggagtttgtggcctatgtaaaaagcctggaaggggtggggacggtgacccattcgtccgaggtggtgaatgccctgataaggctgaaagagaggattacggggatcggcgcaggatgtctgtttgtactgattctgctttcggtgctgctgatacgaagcacgcttctggttacggtggcttcccagaaggataaggtgcgggtcatgcggctgatcggggccagagaggattttatccgcattccctttattgtggagggcctggtgctgggaattgcgggaatgtgtattcctatcgctttgctctatgcaacatatgtatatggtatccggtttgttgatgttcatttcgggctgttcggcgcgcctctgaagcttctgccggcaggacaggtgatgcctgagctgatacaggcttcggtcgctttgggtgtgctgacggggataatagggagtattgcggttatggggaggttaaaaagtaagtgagtgaatggcgtttggaagaatggcagagcagcggattggggaaagaaaatatttgagaaaaatttgttgcgaaaaatgaaaaaacatattgacagatctggtattattttgtatactaacattcgtcggctggatgtctgacccgctggaacgcatcgggttcagatgataagagttgtaatttggtaatggtatttaacgattatcagacagctttacaagaagccaaatccgcagaaagccgggcgggtgtggtatatatatcggggtgtggctcaggtggtagagcgctactttagggaagtagaggccgcaagttcaagtcttgtcactccgactgatgaaaacactgtaaacttaagggtctgcagtgttttttcatgattattttgatagaatgtgacaggcaagatttttatgttccatcctatagcctgccatatgcattacctgcgcttataattactggtcatcaattacagccttaattcttctgacaccggcagaagaggtttcctctttcagaattttaaaagaaacaagctccccagtattctttacatgagggccgccgcaaatttccttggaatctttgtgccttcagtctagcctgcatcatttgatttcaaagtcattatttcgccattccttacaggaacacaaaataccatacataaagctattgtcctattcgccttttatttcctcatatgtcttcgcaccgtttgctattaagtaattaattatttcatcgttattggtaaaataagctttatccaaaggtgtttgttcaaatttgacataatttacatctgcattatattcaacaaagagttttacatatttaaaatcattattttgtatgacaaaataaaacagctgcgtactccatgtcgcttctgcattgggatctgctccatagtctaacagcatttttgccatgtcataattatcatttttaacagcgtagtaaattggcggatatatgtattctttttgtttatttgggtctgcacccttttcaagaagagtttttgctctatctatgttatccgcgtaaacattatattcaattgaattcctttgcgaaatgctctgcttaatgtcgctggtgatattaaaaccaatgattaagagcaacggcaatgcagataaaaaacctaaaacaaaggatattatgccaaacaccgacaaaacccggcttttcttatttctttttttagcccatcttgaatttacgaatctaaaaacaatgctgagaattattccgccaataccaagcacaaatagaaataaagaaatactggcaatcgtcatcgcaataaacgccataacaatactcctttcaatatgaggacgtataatcacttttctaaactatgcgtctatcttttgtttctgaagctgagaattaaagatcccttaagtatatgaataataccattcatatactgaccccataagaataatgtccgttcattgagacataagcattattattattggcaggcctaatattaaatatataacatttacccctaatacaataatcccacctattacattcattcttctcctgaataaaaaataaattgagactgctgcataaataacggcagcgattggagtgacaaaacaaattactaaaaacaataaccccaatatcataccgaaaggtaacgagagaaacaggaaggcaagcattggaaggcagttaaggatgcttaaactgagtaaagctattaaatattttttcataataaatccccattatagaaaacctcatcagtatatgtatacatcgtcatatcataaaagaatataagaacaggagataatatttttttcaagattcccctctatatcttttcatgataaaattatcttacaagaattttctgtaacaggcaacgaaataagactgaaaatcaaataacattgtttgaaaaagagaaaagaaatattacctatactatttataataaggaaggaacagaaaaaatgagagttttatttatcgggaacagccatacctatgtaaatgacatgccggaattgtttgccgggatggcgagagaaaaagggataccctgtgaggtgacgatgatcgcccacggaggatggtttcttcatcagcatcagaaggaaccggatgtgagatttaatattcttttcggcaattatgactatgtggttcttcaggagcatgctcatccctttgggccggagtcggtcatgatagaggcggcaagggaaatcagcaaatggatccgggaggcagggagcatccctgtagcttatatgacctgggcggaaaaagaaaatgaggccgggcagcagcagatgacggatgcttatcggagaatggcggttgaaacaggagcggttttggcatcggtgggagaagaatggtggaagtataagcatgcccacccggaagtggagatgtatgcttcggacggcgaacatgcttcacttgaaggatccacgctggcagcccggattcttctggaggcaattctggagaaagagcaggaaaaggaaggctgaatgttacgtaaggagccggaaatggctgcggctgaagtcgatcaggccatcctgcttcatccgggaaagttcccgggaaagcgcgctgcgatccacgttcagatattcagccatagcagccctgttaagagggatgctgaaggaacgggagcctgtcttttcggcctccagggaaaggtaagtcagtactttgtcacggatggtgggcttaataagacagtcgttgcgatcgtgtaatacgagagccatttccgcgattccgcgcagtaggttataaaggagacggtcgtgtccggggcagctgctttgggtgagcagcttccgatagggaaggtacaggacggaagaggcttcgtctgcctgtacggttaccggacttttcctttcctggctggcggccagaagtacgccgatatagctgccgggcttcagcagggtcacgatgacctgttttccggtaatatcggttttcagagaatgcgcgctgcctgagaggagaataccgagatccgataccgaatctccctgtagaaggattccttcatttttatgataatccttctgcacggcggccagggattccagtatttccgggatctggttccgggcgatgttttcaaagagaggggttccctccggaataagtgtttttttcataaaagttcctttcgttgcatgtgcaactgatggattttttctatcatactataatgctaagaaaaatccaagtcggaggtatatttttatggaacagaataaaaggattatccggataacacggacggcggtatttctcgcccttttgattgtactgcaggcggctacggcacccttgggaagtactcttctcacaggttctgtggtcaatttcctcctgattacctcggtgatgctctgcgggcctgcttcgggctttacggttgccgtactttccccggtgctggcaagatttctggggataggcccgctgtgggcgcttattccttttattattgcgggaaatatcacgatttgcgccgtatggtatctgattgcgggaagaggaggaagggcaggcgctttcagaaagtgcctggcagtggcgggaggtgctgcggcaaagacggcggtattgtatggagggattgcctgtttcgcggtgccttaccttcttgtactggcggaaccgcaggcatcactggtttccgggatgttttctcttcctcagttttttacggccatggcgggagggacggcggcagcagttctgcttccggttctgaggaaagcggtaaaagatatataaaaaacagcactgccaggggtatgattttccctggcagtgctgtttctggcagaaagagccggtgaattacggctccttatctggtatcggaaggaagggcggttttgatttgttcccggataaaggcggctgtatccgagatatctgcggcgtccggatggcctttggcgataccgccgatgagcttccaggggccattggtatcaaagcccttacactgaaaactgcctgtgacgctgcagccgcagttttctaagagagcgcggaagtttttgctgtaatttttctggttggatccgctggtgaggatggtgaagaccttacgtcctgccaggtctttcctgtgttttttcagaaaagcaagcatggtagcatgaggttcgcccatataaacgccggaagccaggccgataaggctgtattgggacagatccgggaggggagtatcagtcaggggaaccagttcggcgaggggatcaccgccgatggcctgtttcagcagcttttctgtattttggtggtgttgggatacatagaaaataatacatttactcatgagagatacctcctgtcagagcgttttcaacagctttctggataaccaggctggaacaggtggcgccggaaacggcatccaccggcagggtctgggtatcggtgataacatcaagcacctgctcggccgcttttccgcgttcgttgtcatgggagagcaggtcgatatgggtaattcggccattccggagggtgacctgtactttggcataaatataaccggcatcgtattccccttcatagtttccgtcaggcatgcgggaaaaatctgtgccggacaggtggatatctgcaatggccgaacggtagtttccatagtcaatactgtaggaaacaatatgtaaaacaatgcacagaagcatgatgcaggtgagaaggcggtgctgcttgagccggatccggtcatcccggcagatatggcacagggttatcaggagaaccagggtaaacagaatggccgctccggacaggtatacggaaatgtgtcttgtttttataagagaaagggcacagataagatgaatcagtccaatgattagcagggcggcggacaagggcttatgaagcttcataaaaaagttatccgccgctgaaaggccgaattttcttgttattcctttaacgcccagcagacagaagcacagaaggcataaaaagccggtgaggatacccatatcaacatcctccttttaaggattgcagaagcatgcggaagctgtgctgaagaaattctgatttatccatgttcattctttttttcagatagcattctttttcattcgccatgggtatcaggcttcccaatgcggcccagagagtaaaggcggagggcaggatattgatgtcgggggagagtataccttcccggattccctgccggaatatctctgtaatgcagtcattgatttcttcacccacatcataaataaggtgcaggatctcgctgtcggcaagagactgatcatccacggggatattaccgagaatgctgggaaaatacagcggatactgttcatacagttgtgacagcttcgcgcagatacgaaaatagcactgttcaaaatccaggttttcccgggtacattcttccatgctttccttcaggcggcacatgtggctgtatataatgtgttcataaatttcgtctttgcttttgaaatatacgtaaagggtggatttgctgtaatccgcagctttggcaatatcgtccatggtggtctggcggatgcctttttctgaaaacagcttttctgcggtatccagtatgctttttttatgaaattggacgagggcttctttttttcttccggccataaggattcctttcataatcgaactgtagttttaataatcatactatcagttcgattttgtgtcaaggctttgttggccggactttgcagctgccggattttttatctgtaaaagtgggaaaaccgcaagaatgattaaaagcgattccccgtaattgggtataataagatttctgaaggaggagacacctatggcaaaccgcaatatcgaaaatatcacggcagtcattgactatgtggaagatcatctcaccgaaaaactggatctggacaggatagcggaggcggtacactactccaaatatcatctgcatcgtatgttcgccgataccgtagggcttaccgtccatgattatattcagcggcggagactgacggaggcagccaagctgctcgttttttccgacaagcctattctggaaatcgctttgacggcaggatttgaaagccagcaggcatttacggcctgctttacttccatgtataaaacggcgccgggcagataccgggaaacagaacggttttatccccttcagctgagatttcatttagaagggagttatgcaatgctggaacaaaaacaaagacggcagtgggatattgcctttgccgtgcaggaggacatcccctgctggatggagctggtacggcttgttgtcgacggctttccctgcctggatgaagcggaatatatccgggtgctgaaggaaaagatccgcaccggacaggcgctgattctaaaagacggggcaatggccgtgggaattctgctttttaccggtgagacaggaagcattgatttcatgggatgccatcctttataccggaaaatggggattccgaaggcctttttagataaggtgatgggagaacttctgaaggggagggagctcagcattaccaccttccgggaaggtgacagggcggataccggacaccgcagtgagatcaaaggcctgggctttgccgaagcggaactgctggtggaattcggctaccccacacagcggtttgtgctgcacagaaaggagggggaggatggaggagaataaaataccttttccggaggaaatcacgcatctgtcccggataaatgccattctggaaaaggcgctggacagagcggagaattctgtaggacagctggaaagagaataccgggatgcaaagcgttatatggccgacaatcggggagagatagatcccgacgaaatgttccagaacgagctgctgctgaagcagacggacaggacaggcgcctttgccgcggagggaagaaaccggctggtacggctgaaggaatctccgtatttcgccagaatcgattttctggaggagggaagcagccatgcggaaacgtactatataggccgtttcgcttttcagtatgacagggaacccttgatttttgactggcgggctcctgtggcagggcttttctatgattttgaaaacggccctgcaggctttgaagcgccggcaggatatgtcggcggcgaactcaccggaaaaagacagtttaaaattacggcaggggtgttggaatatgcactggaaagctccggaaatgtcagggatgaggtgctgttaaaagaactgaaccatacttcggatgaaaaaatgaaatccatcatttccaccattcaaaaggaacagaaccggatcatccgcaatgaaaaggcggaaacactcattatccagggagcggcgggttccgggaagacctccattgccctgcacaggatcgcctatctgctgtaccgcttccaggaccggctgcattcccgtgaagtaacgattctttcgcccaataaggtctttggggattacatatccaatgtcatacctgagctgggggaagaacccatatccgggacaagcctgtcggatattgcacatcatcagctggaaaaggtcatcggctttctgccggaagaggatccccttaagaaaatggataaaggccgggcggaacggatacggttcaagtcttctatgagattcctgcggcttataaatgaatataaaaaacaactgccctatgctgttttttcgccggaagaatactgtttcggagtatttcatgtaacaaaagaatggatccgtgcccgtttccttgcttatgaaggccagccggtgaaacggcggctggaactggccgcggaggatatcatggaacgcctgcggacggagaatataagggaagagacccttccaaggtcagcacagatcagaaagaacctggaggccatgcttattatcaaaaatccactggctgtttataaggatttttatgtcaaaatgggaattgcggatttttttgtaatgcccgcggctaaaactctggcatgggaggatgtctttccgtttctgtatctttacggcgtatttgaaggctttcgggaaaatggtattacaaagcatctggttattgacgaaatgcaggattatacgccggtgcaatttgcggttcttaacgagatgttccgctgccccaagacgatactgggggatttcgggcagtttatcaaccccaatcatcttcatacgttgaaggatatacgaagcctgtacaaaaatgcggaatttgtcatgctgaataaaagctaccgctccacatgggaaattatccaatttgcgaaaagaatatgtcccaatgatttgatagaacctgtggaacggcacggagaggaaccggatgtgatttgctgcgcggacaggaaggaggagataaggcagattaaggaggagatacaccgttttgctgcggggccggatgcctccatgggaatccttatgagaaccaatgaagaggcggaaaggatggcagagcttctttcggaggactgtgaagtgaaccggattacaccggaaagtacggcttttgtcaacggggtgtccatagcttcgatccagatgtctaaagggttggaatttgatgaagtaattatcccggatgtagatcaggacacttatcggacggagaatgaccggggactgctttatattgcctgtacaagggcaatgcacagactgacggttatgtacgcgggagagagatcgaagctgctggccggggagggagaatccctccgccgtacctgagaagctgtagtgtgatgcagccatgcggaatcagaaaatgttccatatggggaaatggaaggtggggattcctgtggaatagggggctatgtcgtattgctggaagtaaaggatgccgttatatggctccagatagaaattagccagattcaggttttcccttattaaaaaatcgtagttgtcaaaataagtatcgggattttcctgctgtctttcggctatttgatgggtgatgtttttctgcagcttatacagggaatccggggtgagaggatatacgtcgccaagctgaagcagcgtgcagttccttaaattccatgtgtttgaggtacgttttgtaccgccgtgggctccgccggtataggtgtaggtgtctgtgtacaggctcagaatgcatttttcgttataagtcaccgtgaaatcgatgataaattcgtagctgttaaagggacgggcctgcgtatcctttgcgttttcaagggcttgttggtataatatagtgcggcagtagttttcactgtttttcgcttccctgtaataaaaatcgttgatgctctgtacggagcagaacgaggaagaaatgcagggatagttgattttgtaggtgagaacggcggtatcttcatcgtatagggtgtcctctaaggtgtttttgtaatatgtctgcataatatcatccggggattttgattattagtaatatatgcggtggagagggaaaatgataagctttattttggaatgggaattgtaagggaagagagggataaggtatggatcggtttgtaagagtttacagtcagggaatcgttgatgcggttgaaatatgggttgatatggaaacgggggttaattatatgtggcgtaaggcggctaatgccggagggctgacaccgcttttggatgagaacgggaatgtggtggttacgaaaggcgggtatggatgtcagtgagtggcagcttgtcttaagggtttctgtaacgagaatatgattttcttattaagcggcgtgatccaattacatgggttatgccgcttttctatggggataagaatgaagtgtcaaaaataagcaaagagaaaagttgaatggacatattattaaaagatctcttgacatgcatcgcttgttatgtaacaatagttgcataacatttgttttttatgaaagtgagataaaaatatgccgcccaaagcaaaaatatcgaaggaaatgattttggatactgtattggacattacaagacaggcaggatttgatgctgtaaatgcgagaagcattgcagacaagctgcagtgctcaacacgcccgctttttacctgttataaaaatatggatgaattaaagagtgagttccttgattttgccttcgaattttataatcagtatgtcgctgattacagagcatccgtaaatacagattcttgcctgattcttcctttatcatatgttgcgttcgccagggacgaaacaaatttgtttaaactgctttttattaatgatatggatttggatatgacagaggcaaaggatttttataaggaggtcggaaatgaagaaaaggcaaagattttttcagacagcattggagttgaattggaacgcggaaaaaccatatttttagatctgttcctttatacacatggcatagcggtcttaacagcgaccggaaaactgacatttgaccgaaataatgttgaaaaaatgctgaagaatttactttctgcttttataaagcaggaaaagccggattggaaattctttgcttaatgataccttttaactactttaaaccgaaggagcagtaatatgaaaacaaatccgtatttaattgatttttacaataattatgatgaagacagtcgtctggtgttaaaaagcgggtcggtggaattccttaccaccatgcgttatatagagaaatatataaacctaagtgcccgtgtgctggaaatcggtgcgggaacgggacggtattcccatgcactggcacgccggggatacgctgttgatgcggtggaattggtggagcataacattgaggtattccgaaaaaataccttatcaactgaaaatataacgattacccagggcaatgctttggatttatctgctttcccggataatgaatatgatattacgttgctgttggggccgctgtatcatctttatagcaaagaggataaaagacaggccctgggtgaagcgattcgcgttacaaaaccgggcggctgtatttttgcggcctatgttatttccgatggctgccttctggatgaaggattccggcggggaaatatcaatgttgcggattatattgaaaaggggctgattgacgccgaaacattcgctgcaaaatcggagccaaaggatttgtttgagcttgtgcgtaaagaagatattgacgatttgatgtctgtgtttccgacagcacgcttacactatgtcgcagcagacggctgtgctttgtttatgcgtgaagtgattgatgaaatggatgatgatacctttgaattatatttgaaatatcattttgccgtttgtgaacggattgatttggccggtattacaagccatgcgctggatatatttaaaaagtgagtctgtttatccctgttttcaggaaatttgggcaaaacaaaaagcagatagcgggaatcgaacccgtctctccagcttgggaagctagcgttctaccgatgaactatatctgcatgtattagagtatatcataaggtttaaaatttgaaaagagggaatttaatatccgaatataaatgaatgataaaaaatatacagccaaacaggagctgcttccatcattagcccgcagctcctgttttgacaggcaatagagagacataccgccccttctactgtatatttgttttaaccgtacgcagcacctgcagtactccgtcattgatattagtatctgccacaaaccgggtcaggctcttgatttcctttcgtgcattaccgatagcgtagctctgatccgcacgaagcagcatgcttgcatcgttcatattgtctccaaaagccatggtttcaccgggagttattccataccggttctgaaattcggaaagggcgattcccttatcggcgttgatgggagtgaaattcatccattgctttccggcgcataccagctgcagttctttgtgaccgtgccatttctggtaaagcccctggtgtgcgatttcctcggctctcgtgggatgatacatttccacgctgagaataccgtcattagcaggcagatcctcaggcatccgtttcagctttttgatatccagctggtacccttccgtcagccagcggtaaagctcgtcggccccttctttaacatacccgtccttgactgcggaaatataagtagtacatccgggaagggcctcaatctcacgcacaatttccatagccagttccctgcgtatggtataacaggacaaaagattgccgtgataaatcgtacgcgcgccgttatcacagatgaacagaatatcatcaattaccggtgcaaacaattttttcaggctggaataggaacggccggatacagcggcaaaaagaatgccattttttttcaaatggcgtatctgggtaaagtattccgggttcagatcatggcctccgtccggtaccagagtgccgtccacatcagaacaaattaatttgagcatgcagaaaacctccctcagtcttcttaatggaattaacggaaaattatatcgttcattgtagtctgtatgggagaaaacgtcaagataatatggaaaaaagaagagagaaggctagaatgccaaagtaaattccagttcatatatcctaccagatttaagtttgacactccttcctttacaatggacattgcagtatgtctgttggaaaggagtttttatgtccaaatcaattcatacacaaaaacatatgactctctctgatagaatctacatcgaacaggctctgtctaatcatggttccttcaaagatatagctgccgttttgaaaaaggatccttccactatctctaaagagattcgaaaacatagaaggcctaaagacggcagtcattatcatctgaaaaataattgtgctctgctttcctcctgcaattgcagccgtatatgtgatggcaaactttgtaattatctttgcaagcgcagcaaatcctgtgactgcacaaagcattgcccggatttcttcccttatctttgtccgaaactcaaaaagcctccctatgtctgcaatggctgctccaatcatgcctgccgacacgataagtttttctatcgggccaaagatgcgtatacttcttatgaacagaccaagcatgaatgcagacagggaattaatcttaccccggaagaaagagctgccttagacgagcttgtggcacctctcattctcaacggacaaaccatggatcatatttttacggaacacaaagaagaaatcccctgctcggaacgcactctttatcgttacattgattccggtattctttccgtaagaaacattgatcttccaagaaaagtaaaatataaaccgcgcaggcagtctgacacttccgaaaagttaacgagagaatgtaccatcggcagaacctacaccgattttcttgaatatctcgaacagtatcctgaaacaaacgtggttgaaatggatacggtagttggtccggagccgggtaaagttattcttaccatgctttttagaaactgtacctttatgctagcttttctcatggataatacaaaaagcgagtctgtcattaacgtatttcattttcttcaaagggaattagggacggaagtgttttcccgcctctttcctgtaattcttactgacagaggttctgaattttctaatccatgggctatggaatgcgatgaatatggggaaattctttcaaaggtattttactgcaatgcaaatgcaccttatcaaaaaggaagattagaaaagaatcatgagttcttacgctatatcatgccaaaaggaacttcttttgacgctatgacgcagaaatatataacccttgctgtgaatcacatcaattccacggcaagaggcagtttaaatggcaggacgccatttgaacttgcctccatgctgcttgacgagaagctgttcaaacttcttcgtttggaaccggtagaacctgacaaggttctactcaaacccgcactgcttaaacagcgctaaccatttttgaaacagacatactgcacgacaacggcatactctttcagtcagacaaccggaattcagtttgacagacacccttccggttgtctgttttccatgcagaaaaacagactgtttccctaactatcatacatctttctatcaaaaatgccaaagaaaaagttggctcaaccccgcattttctttggcattctagaatttcatttgtcactggaatttactttggcattcaaccaagaagagagaagcacaccggaacgtcaggaaaatgccgtatggaaaggaataaataaaagttatctttatttctttttatataaggctatgttattattaataaagagaaaaagcaggaaaaccggcggaatatgacagccggaaaaggctaaggaaaaggagaactcatgcaggattttcggatggaaacctttctggcagtgtgccgaaacctgaattatacgaaggcagcggaagaactgtgcattacacagcccgcggtgtcacagcatatcaggcatttggaagaatactacggaacacggctttttgtcagtgaaggaaaaaagatggtgcttacggaggcaggccgcctactgcagagcgcgggcctcactatgcgccacgatgaatacgcattaaaggaacttatggcccgggtcggggcgacagaacgcagcctgcacatgggcgcgactatgacaatcggtgagtttgtccttccgtccatgctcagcagatacatgctcagagcgccggaggcctccgtccatgttaccgttgccaatacgtcggaccttctggggcttatagatgaaggaaaactggattttgcactggttgaaggctatttttcccgccaggattatgattatcagatttactccacggaaaagtatattcctattgcaggagccaggtaccagacccgggcgggcatgaatgacagccgcaggatcaggacggaggatctgctcggagaagcgcttctcatcagagaaaaaggaagcggcacaagggaggtcctggaacgcatactggaaggaaagaacctgtcggtaagagatttccgcaagctccacgaaatcaacaatatccacgttatgaaatatctggtgcaggaaggccatgggattagcttcctttatgaagccgccgtcaggcaggaactggatcagggcagtattcgggaaattccgctgaaggattttaatgtggagcatgatttttattttgtatggagaaaaggcagcattttcggcggggaatacaaagagatttttaaacaattgaaggataaggaatgagcatatggaaaagaaatgcgtaaatgaaaaaaagtgcggaagctgcaaatatctgcacatgacctataaagaacagctgaagaaaaaagaagagtttgtaaagcatgaactggagaaatgcccggagctgaaagggcatttcaaaccgattatcggcatggaaaatccatggaattacaggaataaggtaaccgctgtttttgacagagaccggaaaggaaatccgatttccggagtctatcaggaaggcacgcaccgcgtaatcccggtagagaaatgtctgattgaggacgagcttgcggataagattatcgggacaatccgcgggatgctgcgttcttttaaaatcaaggtttatgatgaggatacgggctatggcctgcttcgctatgtgctggtgagaagaggctttgccaccggtgaggtcatggtggttcttgtgacggcctcgccgattttcccttccaagaggaattttaccaatgcgttgctgaaggctcatccggaaatcacaacagtggtgcagaatgtgaataaccgtacggatagcttgattctgggggataaacagcagattctgtatggaaaggggtatattgaagatattctctgcggctgcagattccgaatttctccggcatctttttatcagattaatccggtgcagacggagaagctttatagtaaagcggtggagcttgcagggctgagcgggaaggaaacggttattgatgcttactgcggtattgggacgattggactgatcgcgtcgaagcacgcgaagaatgtgatttcggtggaactgaatccggatgcggtcagggatgcgattgtgaatgcgaaggtgaatgggattaaaaatgtgcgtttttataaggcggatgcggggcggtttttgacgcagatggcggaagaaggggcgaaggcggatgtgctgctgatggatccgccgaggaatgggagctcggaggaattcctgcgcagcgcggctttgctggggccggggaagattgtgtatatttcctgtaatccggtgagtttggggagagatttgggagtgttgaagaagttggggtatcgggcggaggagtgttggatggtggatatgtttccttggactgcgcacgttgaaaccgccgtgcttctcgtgcggaaaccttgattctatgcgggtttacgggattttagccggcaaatggagttgtgtttttatggaaagtgagatggataagtttccatagaggcagggtggggtaaatatttggatagggttttgccccgtggttatcgaaaaatgataccacggggcaaaacccttactttttggcaaaagtcatacaatttggcaaaaccgatactccgaggcaaaagtctgacattatcttatttgaaaccgggaaagctgaccgaaaaacaggttcttgttatggacgctttgtttaaaatatagtaaactgagcttaacgagaaagttgaagttaaagctgtaaaatcatgagcatcatagaccataatatagatggcggaaaagcatttgattggagtacgaggtattggacctcccttactgacacagaaatggcagcatgggaataagagcatatggaactgcttgataaaattgcccctgctgattttaaattatagagacattagtttgcatagtatacttaagttaagtttagagaagtggaaaaaagtgcagattcaagctatagcagacgaggaattcgacaagatgacgttaaaagaaacagacgagatgaaggatatggaagcagctaccaagggagaattgaaagatgaattatacagaaaaaacaaagcccgggatgggagatccatattggtatgagtggtccgtgggtgagcagcagattatcaatatgttaaatgaagacaataatatagattttgttgaactgcaagccaatgtaggattgggcttagatgatgttgtagtaacatatagcgacggaagagtagtatgtattcaggttaaacacacaagagcagatgatacgttgacatttgcagatttagtttattcagcgaaaaagacaagtaaatcattattagctgaattggcagactcatggcaagaagaaagcagtaaatataccgaagttattccacaaatctttacgaatagaagaaaagggcaagtaagttcttcgacaaagggggatgacaaattcgtaagaccagcacttgacgaattttggacgaaattaaatgacgaaattaaatctgcaaaaaaattcgaagatattatatttgaagaatatcctgaagcttggaatgaatggaaaacacagatcagaggaattcaaagtgatgatgataaattaaaatttttaagactattacagctagaaacagagcagaaggatttacaggaaatagggaatgaagtattaaaccacttatctacaggttttggaattactttggatgatgcagacaaattattaggaaagcttgatcacgcattaaggaagtggacaacctctatgagaagtacttcacgaatttatgtggaggatgtatatgaagcattagcgatagatgattatatttctttgtataatcatgaactgataccgactgagccattttttgatagccgaaaagattttgttgaggagattgaaacagaattattgtctggaaatgaaaaagttctttttctttcaggtataccgggaaccggaaaaacaaatatagtcagtaagttatgcaataagagagacagtattattaaaattaggtattatgcctatgaacctattcaaccagataaagagtacttgccgatggatgcttcggagagggtaaaaaaggaacatttctggaacgagatgtttagccaattaaaacagtatttaaaaggttctttgcataaatacaatgtgccattacaaaattgctttatgtcattggaagagatgaaaacacgcttttttgaaatagcatctgcatatgcaaaagacacgggatatgcatttgttgttgcaatagatggaattgatcatgctgcacgtgcaggaattgtatcagagacatttttggctacattgccgagaccagaatatattccggataatataaaattgttgatatcaggacagccacaagagtcttatccgaattatccattatggttaaagaaaaaagatgataaagtaaagcaattagatgtgccaggaattgagagaggggatatattatcactcgtgactcaaaagatatctggcaccagaagtagtgaatataatgcgattacggatattgttgaaaaatactctgaaaagaatactttagctgctatttttgctgtatatgaggcaagtcaatgtgcggatgtaatggagttagaaagaaaactatcagatagaaaactaagcggaaatattgaagaatattattccaatatatggaatagtgctgttggtacattaaaacagtatgattttgtggattacaaactggcaggtgtatttgcatttttgaatgaacgtgtagatggacagatattagcagaaatattctatgaacttgctatacctgtaggttcttggaataatgtattgaaaacattaaaacctttgattgtggaggaagctggtaaatttcatgttttacataatgatgtgaaagttttcttgtctaatattataaatatagatgatgagcatacgcaggaaatagccaattcgttgactgattattatttaaataaagaggataaaagccaagctttttattttgatattgttagattaatgtttatggcaaagcgggaaaaggaaattgttgatgttttttcaagtaagtttgttattgaggcttatgtaaatggtgttgagcttttggaattaaccgatatttcgaataatataatgaagggactgtttctgcaagaggtaattgattatggcaagttgcaatctttgtctacagccattctcacaattgataaacttggagatactaaatatgaaatagtggattctgaatttagggatgcaaggaaatatgtgggtgtggctccatatgagtgttatgtggaaacaataagtcaatgggatgcccgtttgatttcggatgtattatcatatgccagagctttgtattattcaggaaaaaaggaaagggctgttgatttatttaatcgctggtttggaggattaaatgtagtggaactttggaatatgttgagagagaaaggtctgttagacacaagaaatccagagtatattatgatatcaacagaagcaaaagaaatttcagatgatttgggtaaattaatctgttggtcaaagcaatataacatgcttgaaaaggtgtctgagtgtgatgataaaataactgtctttttgtgcggattatgcgaatcattttggcatgaatctgtattaatttataaagatgaagaattagaaacagcccttatttgtgttaaacatattgttgttagaccagaagttttgattgatattttgataaaactgattgatgatttgaatttttcttcgattagtattattgaaaatgtaaatagaggattatttacaaatagcaaattaggcatggttttcgatctttttatgaggatagtttcagggaatatggaaaactatgataagtacaagagagaagatgtatataatcaaattcgagatattgaattgccacatggagatattgagcatgaaatatattattacagtatatatgctgttgtagtgagttacttacaaccggcagtggatcgactcgtagtatcccaaagggtattggataaatatttagtaaaactctcccatagtgacagaagttattatggtgtgtggttcaataacctttgttatcttgggcattggttgtatgcaaaacataatgagcagagttttatagaacttccaaatgagatggaaagaaatttatcgttgcttataatcaaagattggtttccgaaagtgttggatttgcaaacgaggaatatatattctctgattttaaaagcgtatatcattttgtcatcacaagaaaatgaggtgtataaatcagcagtttcaagtgtatgcgaaaaattatttaaaaataatccaatacatcaagttatggatgcagggtggtttttttatagaaataatgttgatagattaacagcgtggtatcaggattggctcggagagggcggaagagtttgggacaatcctataggtgacagaaatagaattatcaaagatatccttcatctggttgataaatatcaattagaaaataatatcgacacatcaactgttagagaaaaggcaaaatggtctgttataggatatgcttctaataaagaatatagcttaaatgatatattggcttggtatgatagtttaattgagacaggctatgaagatacttataaatatactgaacagataaagagcctttctggaaaaatggaagaattgggtgataacagacttgattatgaagcaaattgtaagatatacggcgatttgttcggtgatggattaactgtaattaaaaaggttttatctacgcctgtatatttgtcagaattactaaaacagccggaatatattattgaaggattgataggatatttaaaaaacgcaagtgtttcagaaaacgatttattatctatttgggcatttggcctggggatgttgaattggaaaaatgagtctaaccattcaacgattgctgcattagttgaagcaatagagatttgcactaaaagaaataatttaacatctgtatatgagaaaatgcatgcaatgggaaaagctgaaataagtgttcgtgttgatccaagtcgatatattattccgaacagatggtgtgacaaggtagaactgaagaaaggtgaaagaaattcacgtgattatattgaacagtatttacagactggagaattggactatcatgatagacaaaagttctttgaagaatgtgagtcaatgtgtgatgatagagaggcttattattcttgtttggaaaaactcctggagaaagagctcgttaatgaaagatatggatggaggaatagcgaaatcttaaagtatgcagtaaataatctgccaaattctatagccgataagtatataaggtcttattttataacaggattagaagggggaagagaaagtttttatccgggcgagaatttaacttatttatgcttatggaaagcaaaacaatgcggtcaggagtactgtcaagaaggcttagataatctgctgaatacccataacctttggatttcgtcagctgaaagaattggtattcaagaaaatattaatgaaggtgcagatacggatattcagagagtgtatagtttattgaatattgagagtatagattcagttaaggatttgtttattaggattctcatagtatttatactttctgataatgctgatgcggcggaaaatgcattaaggggcacctaccatttgttgcaaatttatccggaattagtggctaaagtagaagaatactgggataaacttcattatagagctaaagagtgggtgttgatgatttatgaattgttgaatgaaactacagtaatggataaagtactgctggagagtttggttacaaaacatatcaatgattcagattttaatgcgtcattttattcaagaatcatactgcaaagattatgtggtaaaaatgggtttggtttgccaaaggaaaagcaaggatattttacagatattccgaaatatagtgcaaaaaaactactatctgtaaaaagtacggaacaacatttaacaggtacaatatatgtaatggaaacgttgaaacggataaatgaagaagtgggtgaagattgtagtgatatagaaagtaaagtggcagcatatatgaatcaaattagggacactgagcatatgtcacttgatgtaggtggtagaaagcagtgctgtgtagccttatacgatataaacattgcattccttagggttttgtataaagaatggtatcaaggaagatgggatgctacagaaattccgttaagtcgagtaattctttctataagtgaaccttatgttttgttgcaatctccagcgatatggccatatcaggaaaacaaactattaaatgcgaaaatggatgagtttgaagtacaagataaagatggcaaggagaacacgttaaaggatattttctctatgggaatatgtgataatgaaatcgttcttggcggagcattaacggaatatagctataagaaagagctagcaggctttatgaccacatatattgattttcctattatggaaagagattttgcgttatatgcatgtgaaagaaatgtgaggcttttaatccataggagcaatgaatttgtagaagaaaaacattgcaatttacttgtacataacgtaggtgtagagagctttaagggaagtaatattatgtgtatgttttcacagcgtgcattaaatcactttggatggaaaattgtttttgatgatggtttaaagatagtcgattcaaacaatgaaatgataggtagatttgaatattactacgggttaagaacagatatgggaaatgatgtttatatgaatcaacctgttattcaaagatgggtggtaactaaggaagcatttactgaaagtcaaaatatgttggaatatgatttaaaacaagtggccggtgctaaggtctttgaattttagtgaaaatagcatacttaggaaaattccagttgtgcgcccagcaaagggcaattaacctaacaggtgcaaatcctgtctgtttaaggtctaaccaaccagcagtagcgagtcttgcgtggtaatcagtaatgattgttgcgaagcgtagacagcaagcaagtagggttgcaatgcgattgagcctcgaaaagttgaatttcagagggctgacgtcttaactggttcggaaagcaacatcggctaactcgctatggtgagagttcgtcggcactgcggggtcaaagggccaatcatgcttgacatagtggttaattgtcaactggggagagcctattgcttcttggaaacaagtacgcttcatcaactagaagatggagatgggcgaatgagtgataggcagtcggatagcttcatagtactgatgaaactgggtaatgccagcggagggaagggggctacatagtaacggtctttctgaggacacatcaaccgtgctcaggaacggaggtattgatgggaacgaaattagagagaatagcagaaatatcggcgacaacgccgaagccagagttcacatctctgtatcatttgataaatgctgaaatgctcagacagtgccacagagaatcagatggcagaaaggctgtcggaatagataaagtgacaaaagcagagtatgaggaacatctggaagaaaacataacaaatcttgtagggcggctgaagaataaggcatataagccattgccatctttgagggtatatatacctaagagcaatgggaaaatgagaccgctcggtattgcttcttatgaggacaagattgtgcagcttgcagtgaagaagatactggaagccatttacgaaccgagatttctgaactgtatgtatgggttcagaccaaacagagggtgccatgatgcgataaaggaagtacaccacagaatacagaatgactggattaactatgtggtagacgcagacatcaagggattctttgaccatatgagccatcattggcttatggagtttctgaaactatatatcaaggacacaaatcttttatggctgataaataaatatttaaaagccggaataataacagagggtgtttacgaggatagtgaagaaggttcagcacagggaaatatcatcagtccaatgcttgcaaatatctatatgcacaatgtactgactttatggtacaagtttgtagtgttaaaggagaccagcgggaaaagttttctggctgtttatgctgatgacttcattgcaggattccaatacaaggcagacgcagaaagatactatgcaatgctggaagaaagactggggaaattcaatcttgaacttgaagaaagcaagagccgtctgattgagtttgggagatttgcggaaagcaactgcaaacgcagaggaggtggaaagccagagacatttgattatctgggatttaccttttattgcggtaaaggaagaaagagtggaaacttctgtgtcaagctgaaaaccagcaggaagaagcacatgcagaagctgacagccataaaagaatggttgaatgacaacaatgacctgccagcaaaagaactgattgggaagctgaacaggaagttaataggacactatcgctattatggagtttccttcaatggcaaaaaaataactgcttttctccactatacgcagagatatttgtgcaaagcactaaacaggcgaagtcagatgaaaagctacacatgggaagggtttatagatatgctgaaagtgtatccgcttgccaaaccaaagatatatgttagtctattctaaaagcaaatgttattatgaggagccgtatgcgtgaaaggcgcacgtacggatctgtgaggggcttgcggcgtgagccgcttgtctactcgactatcgggaatctgaacagtgcagcaaagcggaatttgaggtatgaaaatgataagagaattttttatgcaaacagaaagaattggattttcaaaatggcaagagggagatttgactttggcagaaacgctgtggggaaatcaacaggttacacaatatatctgtgccagtggaaagttcagtgcacaggatataaaaaatcgcttgagtaaagaaataaccactgggaaaacacaaaacatggaatattggcccatttttgagattagcacaaatgagtttattggctgttgcggactacgcccctataagggaaaagaatacgaaacaggcatacatcttcttccagaattttggggaaaaggttatgcgtcggaagcccttactgcggtgatccaatatgcttttacaatgttggacgcggagaaattatttgctggacataatccaaagaacatcaattccagacggctcctaaatagattgggttttatatatataggggatgagttttatgctcctacgggactatatcacccatcttacgaattaaagaataataagaagtcatagatagcttctagtttatcggggaactgaacagtgcgacaaagtggaatttgttgaggtgagaagatgataacaggatattattgtaccaatatttttctaagcaagctaaggaactgattcagttctatagagtggtattagaaataccgtttattaagacagacgtggatgaatccaatggggtttatcttggctttatagaaaatgcacctactctttgtatatgggattgtgaaatattcaacgtacagccgactggacatcaatcatttgttttccaaacagataatcttgatttaacgatggagtgtttgaagaaaaaaggggttgcactgtctgatgctattagatatgattggggaacttatgaagttcgtttaaatgatattgatggaaacgagatagtaattgttgagtatgtttgatttataatccaaatttgctattttcaacagaacagaaccatttcaaagcatcagtcagagatgattggtgctttttgtatgtcccaaaatggaggaggtgttgcttttgtatccggtgagcgaggcgttcctgcaggcggtgcaggagaacacccggagattttactggaccgggaggattacaaccaaagccgggattgtatatgagtttgggaatgaggacattgtgaaaggctccggttacatcaccagccagtgctgcgggagcacggagattgagattggaacggggtgtatgcggcggagatggggattactttattttcggagattgaccgttataccttggaggatgggatgatagagctgtcctatcatctggtgctggaagatggggcagtggagacggtccccatgggtgtctttgagattagcgaggcgaaccggaccatccgctgcctggagatcaaggcttatgatcatatgctgcggtttgagaagagtttcaacgggtttgagacggtgggaaatgcctatgcgtttctggctctatgctgcaaagcgtgtaaagtggaactggcgcatacccaggcggagattgaggcaatgccaaacggttcggagatgctgtcggtgtacacggagaatgacattgagacgtaccgggatgtgctgttttatgtggggcaggttctgggcgggtttttctgcatcaaccgggaggggaagctggaactgcggaaatacggcaatcagttccacgaacatcaagacgcagacggcggagtattatgcgctggagccggatgacgggctgaccatgaacctgggggtgaacccgctcctgcagtttgggctggaggagacaaggaaggtgctgctggaaaatatcctgtctgatttgtcggtcatccggtatgtgccttttgattcggaaaccattgggaatccggcgctggacttgggggatgtgctggtgttctccggcggccatgcggatgaaacgcagacggcctgtgtgacggggtatcaggttaagatcaacgggaagcattctttgaagtgtgtggggaagaatcccaggctggcacaggcgaagtccaagaatgacaagaacatttccggcctgctgaaccagatcgaggcggggaagattggcatccatacctttaccaatgcttcggcttattcggtgagtggtacggatgtgaagattatcagtattgagtttgcggcggcagaggagacacatgtacagttctttgccatcgtgctggtggatgtggcggcagaagaaacggtgcagggcgggacggcatcggggacggtggtggtcccggttccgtccgtggcggaggacggcacggagactacggtggatgtgagcgtggagatggaactgccggtcacggtttctgctgacgggaaagctattgccagagtaagatatgaatttaatgatgaggagattctgattcactatcccacagagacctgaggcagcgggaggcatgtgctgcctctgtattatccaattgagaacctgatcccgaatttcacgaatacattcaacgtgtatctgcggatggatggagggaccgggcagattgagacgggcggatgtatcgcttctatcagcggccaggggatggcggcggccccggcgtgggatgggaagatcacactggaagaaaatattccgctgttccgtgtgggtggcgggatgattgtgaaaggtttttcggaaaccattggggtagagaccatggaactggtgcagaggcagatggtggacagcattgcacggatcggcattggtgcgtttggcactgtggtggataccgggtaagccactccactaagttcgtgaggaacctcactaagtggaactgacatgtatcgcgcctaagtgaccaaaagacggtcactaagtgctcataacgaggagggattatgaagctgacaggtaatatgaggattgaactgacggatgtgaataccggggaagtggaggccgtggaggaggggaacatggtcacaaacgcggtgaaccatatcttcgggctgaaccctatgggagtgttttatgaggccgcggagactattgacgggattgcatggaacggaaacctgctccccatctgccccaacatgataggcggcatcctgctgttttccaaggcgctggatgaaaacgtggacaatatttattccatgtcggataaccttccggtggcttatgcgtccaataacgtgaattccacggcaaacgtggcacgggggagcctgaagcagacggagagcaagaaactggataacgggtataagtttgtatgggagttcacacccagccaggggaacgggaccattgcggcggctgcgctgaccagcgcgcagggaggaaccaatgcgtatggcagcctggtggcggatgcggatacgttcctgctgctgaaaagcctgaagctggacagcctttccacggcagagcagctcgtgctgtttgaggcggtggaggtggattttgaaaaagacctgctgtattccatcacgtaccaaggtacgggggtgcgcatccggaaggtgcgggttcccatttttaccatcgggctgaatgagaggctggatgataccacttacagggtgctggatgatcaggtgatccaaacggagacttttcacttccttggggactatactttgtacggggaatttctggatgggcaggatgggtactggtatgggttttctaatgaggggaattcctccgggaatgccacgatactgtgggtgaggataaagaaagaggactattccatgacggaggggcagtggacgctgtccaacgccaaactgatggacgtggggagccgggatgaagcggggtcgtttccggagcgggtactgaaatgctgtgtgcggaatgggtacctgtatgtgatggcttataataagaagggcatttataagatcaaccttgccaatcctgcggatgtgacactgattgagctggggttcacatccaaatggaagccgttatgcgatacagggacctgcgaggtctatatgactttgattggggatctgattatcggcggggatttccagatcacgattatggataccattatccacaccaaggggagtgcgaggctgaatgacgcggcaacgccgctgttccagtataagaacttcctcttggggtggggcggcagttatgggagcgagtaccggaccatgtacctgctgacaccctatctggcgtccattaacaacctgtcatcagcggtggtgaaaacggtggataagaccatgaagatcacttataccttgacggaggaagctgccgtgacgtaagaaaggcagcaggaaaaggggaaggcatatcagaaaaaggaaaaaagcatatggagtttgggaatcggcggcagtccagaaaagggctgctgctttttctatagtaaaaaagcggaagcgagggagtggaatgaaggaatttgtgaatctggtgcagtgtgcgtttgcggcagccgggggatttttcggctggtttgtgggagggctggacgggctgttgtatgccttagttgcctttgtggtggtagattatcttaccgggctgatggcggcgggactggagaagaagctgtccagcggcgtgaggttccgggggattttcaggaaggtggtcatcttctgcctggtggcggcaggacatatcattgacatccatgtggtcgggaacgggagcgtgctgcgtacggcggtaattttcttttacctgtccaatgaggggatttccattttggagaatgcgggcaggattgggctgcctgtcccggagaagctgaaaaatgtgctggaacagttgaaggaggagagggaagatgaaggtaaataaggagtatgtgtctgataataacacttatgagagcaatcatccgcagtatatcgtggtgcataacacggataactttgcggcgggggcggatgccagtgcccatgccagggcgcagtataatgggaatttgagcacttcggtgcattattatacggacgataaggatacggtttatcaggcggcacctcatggacggggatgctggtatgtgggcgtggattatggcggacggatatttgggacggtgaataacaagaacagcatcggtgtggagatgtgtgtgcaggcagggtatgactacaataaggcgtttgcgaatacggtggagtttgtgcggcagttgatggcggagaccgggattccggctgaccgggtggtgcagcattatgacgtgtgtgcgaagaactgcccgtcccagatccgggcaaaggggatgtgggaggaatttaaacgtcagattggaaagggcggttccgggcagacggaggatgtttcttactatacaaagattatggggaagagtgtggtatctgtggagcagatggaacattatatcagggagaagaataaagcggtggcacagtccgtggtggatatgctgccgctttatctgtctgagggggaggcagagggcgtgagaggggatatcgcttttgcgcagttctgcctggagacggggaactttgggttctccggttcggcggtgacgctggagcagaacaatttctgtgggatgggcgtgatggataacggaatgaaggggaattcctttggcacggcgcagcttggcatccgggcgcaggttcagcatctgaaagcgtatgcctgtacggatgagttggtgaatgtgaaggttgacccaaggtttcagtatgcggccagaggttctgcgccttatgtggagtggctggggattcaggagaatccgcaggggaaaggctgggcttccggcgcggggtatgggaagaagattctgatcattttaaaaggcattattggggatgcgggcagcggaaatccgggtggaaatggagaccagccaatccagccgttgtccggatatgtgaaggtgttttacaaagggaaggacgggctgaatgtacggaaagcaccatgtatgggcgataacgtggaccaggtggtctatgacgggatttatacggtggtgggcatcagtgcggatggggagtggtataagctgaaatccgggctgtacctgacaacggggaaagagtatgtgcagttcatggagagcctgcctggggaatcttcatatatggtgaaggtgggcatcccggatttgaacatccgcaagggaccggggacggatcatgccaggaccgggaagtttacgggagccggggtgtttaccattgtggaggaagctgacggtgcaggtgccgggaagtgggggctgttgaaatcctaccagaagaaacgggatgggtggattgcgttggattttgcaacaaggatatagcggaaagaggtgtattgcccggtggggaaacctgccgggtttttctttttacccttggaaaataagtttccgcagtcgggaaataatgggcgtggaaactgcttaattgcttgacttatggggcgttcagagtgattaatagactaccctgaaggcttgcttttattaagaagtctgaggagtaaaatacacggaggtgagaagcatggtgataccggaaaggaaaaatcaggtggcatattattacgggaccacacactgtgaccacggttacgaaaggtatatagaaccagggaaagaagtgcttcggaaacggtatggggagatcaaaaaggaagaatatttcttctgggatgaggcatctggcacggatggaaaccggaaggagttccgaaggcttatttcagaaatccaggcaggccatatccatgtggtagttacaagagatgccaccatgatcgcccgcgattggaaacagttctttgaattcatgcagacatgtgacaaggccggggtggatgtggtgtgcatccgggaagatagagatgcacaaaaacaatatacctgtgtgaagcaatttgtaaaagagtattttggacgggagtgggttttatgaggatacggatgatcgagccggtacagagcaaaacgccagaaaagaaacgtgtctgtgcatatgccagggtttctacggattctaggaagcagggggaatctttggaaaaccagattacttcctatgaacgttccatcaaatcaaatcctgagtatgaatttgtgggtgtgtttgccgataagggcatctccggtttcagccagaaccgcccggaatttcaacggatggtgcaaatggcaagggacgggaaggttgatctcatcatcacgaaatccatctcccggtttgccaggaacacagcagtgttcctggaagtggtgagggagctgcggcagatcggcgttgccgtgtattttgaagaacagaatatcaatacgttatccggggacggcgaggtcatgctcactgtcctcgcttcatttgcggaggaagaaagcaggaacgtgtcagagaaccggaaatggtcaatccagaagaagtttgagcgaggagagtacatgatcaacacagaacggttcctggggtacgataaggatgaatttggagagctggtcatcaattccaaagaagctatggcagtccggttctttgcagatatgtatctttcgggagtgggttccagccgcctggggcagttggctaattttctgggaatcccgtctgtgacaggaggaaagtggactggcggctcatttatgggaatgtttaaaaatgagaaatacaaaggggatttccatttgcagaaatattacacaccggaggataggagaaaccagacggtacgaaataatggggaagtacagagttattatatggaggacagccatccggcaattttgagccgggaagtatgggatgccctgcagaaaaaaatggaagaaaacaagcagaaaaggaacattgcccagggggatttcatgaagtaccagaaccgatatcctctgaccggaatgctgtactgcccgttctgtgggaggacgctccggcggaggatgggatacaaaaagaaggtggagtggctttgcgccacttatattgaagaaggaaaacaagcctgtccgggtgtgcggattccagatgagtcagcatcccggcagcatatcatagaaccagcggtggtagaggaggtttacggggatggcaagaaacattaccgttatacctgcaagaaagaattcgacagacgcagaggggcagacggcacggaagaaaaaattgagggtggcggcgtactgccgggtgagtaccgaccaagaagaacagctattaagctatgaaaaccaggtgcggttttatacggaaagcatcaacagcaatccggaatatacttgtgcgggaatctacgcagatgaaggtatttccggtacaaacacgaaaaaacgggaggaattcaaccggatgattgcagattgccgggcagggaagattgatcggatcattacaaagtctattttccggtttgcaaggaacacactggactgtctgaattatgtgcgggaattgaaaggacttggcattgggattacatttgaaaaagaaaatatagatacgctggatgcaaagggagaagttttgctgactattctttcttcattggcacaggatgagagccggaatatttcagagaacagcacatggggaatccgaaagcggtttgagattgggcagcataagatgagtaccaagcgttttctgggatatgatgcggatgaggatgggaagcttatcgttaatacacaacaggctaagattgtggaacggcttttcatggaattcctttgggggaagaccactgattatatcaagcggatttttgagcgggaagacgtgaagaactgggacggcggcacgaagtggcaggccaccacacttggaagcatgctagaaaatgaaaagtacaaaggggacacgctcttgcagaaaagctacactacagatttcctgacgaagaagcgggtgcagaatgagggggaaatccagcagtattatatcgaggatgaccatgaggcgataatagagccctggatttgggaatgcgtgcagttggaagcagagagacggaaacggtatctggagcagcataacatcacacggttttcccagaacacggaggtgaacccgttttctagcaagattatctgcggggaatgcaatatggcgtttgcgaggaaggggtggcggacaccaatcggagatcggaaggtgtggcagtgcagtgagcggtataaggtgaaaggcatgttgggatgtgcgaaccggcatattgacgaggagacgctgattgagatttatcttagggcatggaacaggctactggagtgccgggagatgttggtgccggaatgggaaaggcagatgcaaggggaggatttgctggcgaagttccgggctatggactttatggagattacgaaggaggcacagccaatcaaggaactggatattgatttggtgcttcggacagtggatcatatcaaggtgtatgagagcggggtggttgtgacagtgtttctggatgggacggagattaaatgctccacataaaattgaaaatattgagccaaccggtataggaatgatactggttggctcttcctgcgtggaaggtataatacaaaatagaatgtcacttagagattattagcaatttagcattactattggacctttcagatgacaaataaggggtttttgtgataaaatgtagaaagatgttgaatatccagttgagaagtttgtataaaaacttatgaggaggcattatggcaacgtttcgtgaactgaaatttgttagaaacttaagtgaacgtggggatacaaattcaaaagttgacttactacaagaagaggggacagataactttgttgttagaaaaatgatatatgggattgatattccgctatatcaagctgtttttacaagagaagtacgggctttatataaattaaacaagtgtgataatatagtaaggattttaggtcatgacaacttaatggtgagaaatactaaagagagagtgggagtaatatatctggagaatattactggtgtaccattaagtaaggctattattcagaatctgtcttcaaaagaaaaatttcagatagtacagcaagtcattgaagcagttattatatcccactccaatggaattattcacagagatataaatcctaataatattatggtttcagaagataagactgttaaagtaatcgatttcggaatttgcaagattaaagatatgattaatgtagcaacggtctatgctttaggtacgagtgcgtattctgccccagaagtgcatcaacatagtgaaaatgcatcggaacaaagtgatctgtactcattaggtgcagttatatattttttgtttacaggaaagcaaccccctttagcaaacgaattccaaaatattatcgataaaacatcaggtatagatattgaattgaaaccaattttaaagaaattggtttcagaaaaagttgatgataggtatgaagatatttatgagacaagaaatgcatttgcgagcatatttgttagatttttggatatacaaaaaacagttgtttttacaatggagtatgaaaattataataaattaaagtatcagaggttgttaccaactacggtggggataagagaagcttcggacgaatatttacccaataattttgtcgatttatatgctttttgtaaagatggagaagatagtgaagcgacatatacatttctaggatataattacactatggattgcacatatgatgaaatgttaaacattttttgtgttaaagattttcagaagattgttccttatattagagaatcattaaaaaagaaatatacgccaataggtgctaaagttttatttattgataggaaatatgcatatcgtcaacaaaaaaatgatagtcttgagattaaaaatattatacaggactattataatacatatttatcaaaaaacaatgttgattatgaatataaagataattatggagtgtggagagaactattaactttaataaaggaaaacattgaaaatagtattgttaggttaccctatgattcatttaaaattgaaggcgatattttgcgctttgttttgcaaaaaggcacatttatagatgaaagtagactgaccaaagaacagtcttttgtttatgagaaaaaaatacgggggaaacgagataaggtaaaggcatttttgattggtacatatgaaaatgatacatttgagaaagaaaatgtgattctagaaattaagaagcagagcacagtcagtctgccaagtagaggttatatctgtttggactatacaaaagatatggttaatgttgataggcaattagaggcattagatgtattggagaaagaggattatcaatgttcttttaatttgaaacgagttatagcgggggtagaaaaacctacagtacatcaaattacaaaagaacttagattgtacaatgagaaattggattttccacaatcaactgctgtacaaaaagctttaaatgcagaatcaatagctataattcaaggaccaccgggaacaggtaaaacaaatgttataatcgaaataattcgccaaataataaaagaaaatgaaaagaatccagaattagaacctaaaaagattttgttagtatctcagtcacatcctgctgtggataaaatgattgaagacttaattaaagattgtaaagagcgtccagacttactaaggataggcagggatgaaaaattaaatgaagaagtgcgagaggattatgctctttcttatgtgaaagaaagatgggtaaaagcagtaaaaaataattgcaaaaagtatgcagatacgcttttgaaggagataggtataacagaagaagaattttgcaaatattatcaagaaaaggaaaaggctcaaatagaaaatgaaaaaggtaaaaatgtagataaagatttcataaaagcttttgaaaagaagacatctggtataaagtccgaaagaacacgaaaaatcttagagattcagaaagagtggatagagcaaattacaagatgtgaagaaacagaactctacataattaaaagtacaaccattattgcgggaacatgtacaggctttatttcaaataaggttattaaaaatgctgattttgattatgttatcgtagatgaagcagctaaagctacttttccagaattagcagtatcactaaataaggcccataaaataattttagtgggggatcaccagcaattacctccagttctagacacagacattatacgtgcgaatagtgaaaaattaaatgaagagaaactggctcatggtatttttgaaaaattatatgaaatgtttcctatagaaaataaacatagattgacaatacagtaccgtatgcatccaacgatagggacactaataagtcatgttttttatgaagacgaaatccaaaatggtgtagaggcttctgaacgtcagctaaatatacaagggtatgaagacattgcaattgaatggataagtacctccaataagccagataaagaaagatatgaaatagaatataataatgggaagaaatcttataaaaataatctggaaagaaagattataaaagaaaaattacttgagcttgatgaaaaactgaaagaaaaaacaaaagttgcagttataaccgcatatattcctcaaaagtatatattgagtacaatggttaaacaactctcatttgaaaaccttattgtggaggtagacaccgttgatgcctttcagggaagccaaaaagatattataatatattcaacagttagaagcagcgctaatccatataaaatcggatttttaaaatctgaagcacgtttaaatgttgcattttcgcgagcaagatgtttgttaattattgttggtgatttgaagtttttggataatgataagatacgaccaaagaagttttttgaaatagtggaatatattagaaatcatgaccactgtaggatagttgaatattaaggagtacatggatatgaataaaatcatacagtcattagtacagacgataccgaaaaatttaagtggttcttatttagtgaaaactacagaggtatttgttccatataaagaaattggtattgaatgtttaacaagagaaattacggagataaacttgttttttgaaagtatattaaaatttattgatataggcgtacaagacattgatgaagtggctcatattctaggtgttgattatgccattatcaaagaggttgtagtagatatgattgagcaaaaatatcttgttacaacagagaataaaataattatgacacccagaggacgaagagcgttagaaacgcgcaaattggtaacaatccaaaaacgatttataaatcaggttttggtcaatttgattacaggggagattgttagtggggatggaatatttaccactagggttgaaaaaaatgatatatgcttaaacgaagaactggtagtagataaagcatatttggaaaatcatcacaatactattaatgaaatttttcaaaaatatcaagttgaggataacgtgtttggaagacatagtattacgagagaattatataaaatactggatttggcatacgaaaagttagtatatattaaaaatcaattgtatgtatacaaaaattttgatgccgaagaatatcaatttgcatttaaaaaggatattaatgaacaatatgttaattgtttttataggcaggtaaaagatgtggttcctcccagcttggaaaatttttttgaaagggactattcctttgccagttcacatagtaaaaatgttcctcttgataacatactacttgaaaaaacacaattgctatgtaaattattgaatgatagtggagatgtgatacaaaaaagtatagaagagcaatttaaaaacaaaaggtatatgcttactgatgatgaatataggaattttttcttacatggttctgaatttatatgggataagttaataattgttagtggaagactgaaaaagctgtttgataatcgtatttggggagaaataagaaatttatcaaggaataaagagatatatattgtatttgatgagaaagagtatggcatagaaaatgaattgaataaattgaagtctaatagcgtaaagagacaaaatattattctgataaaaagaaatggtttaagccagaataatatatgcttttttccagcggtttcaataggaatagatgaagaagtatatgaaatgtttaaaagaccagttacgttgagaaaaggtatcatagagtttgaaaaagagtccatagaagaaacagtaaaccaaatccaaactgattttaacataatattcaacaatgaaaataaagataaaaatgatacaagagatcagaaaatcaacagaaaattttcaaaaaggagttatcaaaaaaagtaatcttatatttccttgacaaactgacagtccagagcaattactggattatcaaatttgttaaggagttgatgctaaatgacagaagaacagaaacaaacaattgtgcgtcttagagacatgggggtgggctataggaaaatcgggatagctttagatattccaagggacaaggtacgtaactactgcaaagcgaaaggtatagacggatatgccaagcaccttattgagaagaaagaatggaaacagatggagaaggtgtgcccggaagtcatatgcagacagtgcggtaatccaattgaaattaatcccgatgggcggaggcgtgtatactgttcggataagtgcagaagggagtggggcaaaaaacatcccactctttataagcatgaatgtctgttttgcggtaaagagtttgaaagcagtaccagggagcaaaaattctgtagcagggattgttatgtgcggaatcggttttggaggcaggaagacacggaagaagtcgtgaggcttttgcttgcaggtaagaaggtgccgaagattcctaaatggatgaaagaattgtttggtgaatgaaacgtaggttcttgatttgctgcaaaaaaatggatggggcaaaaatcaatctccaaaggggtgaattttcttaaataggggtgaaaaaccgctgaaaggggtaaaccagaggagagaggtaatctatggcgaaaccccgtaatattaggggagaaccttttgccatgtagtataagcaacaactttcaccgcatgtagagtgcgtagtattgatgtcaagggatgagaagtaagagtacggaaaggcttgaaaacaaggaattttcaaaaatgaggagtgatttttgtatgtttcgagttggcgaaaatttctataaaatcaatgtgtgggaacatatccatactgatagttaagtggacaaaatggatattgggtatgttgtgtagataggatggatatttaatatgttgagttgacaggattgttgaattggctaattacggtgttgtattattagattatgttgattaggcgagaaataggagggagataagatatgcaagaaaattaaaaaatacatttcatacctccggtaccgaaacgggaaaaacgtgtcggtatttattgccgtatcagcacaaatagcatgaagcagttgcaaagtttgattgctaaagtatctcatttaacaaggcttacggcagttatgccacaatggttgctgtcagatgtttatatggatgttgcgactagtaaaacgggggcgtcacgcaaagagtttaatcgaatgttagttgactgtcgatcaattaaactggaaatagttcttactaaaagcattagtcggtttggcagagacactgttgaaattttagatgcgttacatcaattaaagcaattcggtgtaagagtgatttttgaacaagaggaactggatacctgtataacaggaagtgctatggctataaacatgataaggatggcaagttgatcattgatgaacaaaaagctgaaaatgttaaactgatatttaatttgtatcttagcggtcaaagtgttatagagattatcagagaacttgagtaaagaaaaattctctcgcctaccggaaaagtgaaatggtgcaagagaacgattgatgtaattctttgtaattgagaagtacactggaagtgtccggcttttgaaatctggtaagagtgaggttcaatatctggcttcggataataatccagcgataataaataaagaagtgtttgcagattgaaaagaaacggagaagtaatatggtaaaagatgacaacggatggcagagaaaaaatgagaaatataattcaaaaaagaaaatcgaaaacaactagcatttgaagatataaccggaaaaaataataactaaaatgaggtgattttttgcaatcaaataatagtgagttatattggcgtcatatttcaacacatactgaacgttcagctgaagatcgtgcagcagtttcaactttagaaacatttctgacttcagatgggaaaattaatacaaatttctcttgtgatgataaatggccaaatcatgatggtacatttgagtttgtttcagaacccgaaatatctagatgtccagaacagaattttatagttcagataaaaggaacgcatatttataaagaagttgatgggattatttcatatagcttgaccagcttagcatttccggcttttatagctagtgaagtaaccgcagatccaggaattttatttattgttttaaatccagatgtcagaggcgagaaacgcattttttggaaatatttatcacctggttttatccaatctatagactttggaaaaaatagtactacaattaaacttagttctgaagatgagatagaagatacagatgaaagcgttaatatgttctgccataagcttcaaaagattatcgatattcatttgtttctgagtaaattagataaggataatctcagaaaagaggatgctttaaaaatcattgaaactagatgtgaggatatatcgttagaaattgatagaattagtgacaataacaaatctcgtgactatatatctagaagaattatgaatggattatatgatttgtgttattctgttctagttttaaatgcaataaacttgggatatacgaatgtcaatgaaagattggcgtgggagttatcccaatttaatattgaaactaaatatttgagtaactttttgaaaggtcttaaatatatcggttcaagaattccagaagaaggtcaatcagaaaggttaatgctgaaatattacaattatctttgggaaattagaaggttcttaaaaagtaatttcaatattgctgtattgagaaatctggaattattccctttgaatacggatactcttgatatagagtattatgaaatggtagcttcgagtatttgtgcaattgatttatcaccaaaagtaccgaggacttccagatattatattcaaaaaaagactcccttctttgtcaaaggggaaagatattttgaaatcacattacagcttgcaggactgtatgcaacgaaatttaatcgtataactatatatagcaagcaaaatatatcaactaattactcaatacaagttgcatatgccgatgcagaaattaacctttggggtgcaaaaagtaaaattaaagtagtaacgaattggaaggtgtctattgccccttcatgtttgaataagttaggaaaaattttaaaatttgatattaaattaaataaaaattatggcgaatacaactcattgatgaattttctcactaggacaggcatgaatttgtttgatttaattaatatacatgaagataactttcaaaatgctttggatcaaatctatggagagacaaaaacttatacatttaaggatgtattgattaaactgaggagagattattcactttcttcaaataaaaaaggaaagcatacaatacgatacatattattaaacctgcgggaagaaacgttagaattcgtgctacccagtacatttgataagaattgtctttctgatgatctttatattacgagtagatgttatccatttgagaaaaaaccttttatttcaaatttagccggaaggaaaaccagtaaaggtaatataaaagatatccttgaaataacaaatggttctgcggagtttaatatagtacgtccttacttagcaattgaaagtatgatacgtgaaacaggggagttgtactttgatattgattcggtagcaagccgggaagagataaagaagtacaattctagtctggatcagtgggaatgcagtaacggttttatgataaatgaaaaaaatggatttttatccattgcctcttatgaaactacaactatatttatacttaataaattgttaaagttttcaaaaatgagtaatagagggcaaaaggagtcaaatttacgatatcttaggcaatgtaatataaatttcgaagatcagttaaaaagagttgccttgcaaaagttatttgtaaattctcaagtaatgcttatttacggagcagctggcaccggaaagactacgttgatcaattatatttcaaatatgatgaataaatcaaagaaactctttcttacgaaaacacatactgctttgcagaatttggaaaggcgtatagaaaatccgggtactgattttgattttataagtattgatagttttacaaagacaattacacttacagattatgatatagtttttgttgatgaatgtagcaccatagacaatagaaccatgaaaaagttgcttgaaaaaattgatgaaagtaccttgcttgttttggctggagatatttatcaaattgagtcaattgattttggaaactggttttattatgccaaggatattattaaaacggatggtgccaatgttgaacttttaaatacttggagaacggacaaaaaagagttaaagggcttatgggatgaagttagaaaaattcaacctattattactgaaaaactcgcaatggatggtccattttcggctgatatcggagaagaaatattcgtatctcaggatgaagatgaaattgtactatgtttaaactacgatggaaaatttggtttgaacaacatgaacctttattttcaaaatgctaacactaaaagcgaagtatatacatgggctgagtggacttttaaagtcggagatccagtgatttttctcgataccaagcgttctcccttattatataacaatttaaaaggaagaattgtggacatctcgaaaagagattcagctatattatttacgcttgatatagacactattttaacggagcggcaatgcagaaacgaaagtcttgaatttgttgatgtgacagagcgtggaacaagaatacgcttagaagtgatcgctagtgatgatgaatcggcagcagaggaagaacgaatcaagacaattattccttttcaaatcgcatatgccgtttctattcataaggcacagggtttagagtataactctgtaaagataattattccttcttataatgcagaaaaaatatcacattctattttttacactgcaataacccgtgcaaaagagaaacttaaaatattttggagtgcagaaacaatgaaagccattgtagaaagttttgataaagaaaaaatcggacagcgtactcttgagtttatagaaaaaaagttagaataatataattgcctaatcaaacatacaacgttgagaagataagatggttgctaaaagcttgaatttcaaggacttttagcaaatgtggacttattttgttatagcctaactattacacgtggaggcggtagttctgatgtctaaggtcaggtaaatatgcataaaaaagacctgatttgagtttctttgttaccgagggtatgaaacattcaatccgaggtttaaacattcgttttcggaaacaggtagatgaggaattatcgagaaaattatggatagtttagatgccgatttagatgtcaggcattgaaacagtgatttagatgtaagtgagagtttaggtagcggactgaataattataaattgttaataaatccatggaattggcggaatagacgaaaatggtgccaaaaagaggcggagcaatgaaaaattgttatgaaatcaaaagagagattgatgtacaatcaaaaaagctaaagagtgattatcaaagggcctatgcataccacaaagacctttttaaagatgattatccaattcaaaatagacgtgggaaagaagaatatagctatacaaatgcaacctacaaactggaacccgaggactatattttttataaatttaacacttggaattttggagcatccgtagcattgagttctaaagattacattattgtagaaggcattcacataaattattgtatatttgaaaattgtaatattgaaaatgttacttttagaaattgcagttttacaggaagtaaatttattaatgtaagattgcagggagttatttttgataagtgtatgttttcacttccagtaatggaaaacggttatcatgaggtagacgatatatattatgctccaacattatttgaaagatgtatatttgtaggtgattttattgaatgtgatatagatcatactttatttgaaagggctaatttcacactttcaaattttatgcatgtaacgttacaatattctgtaatggatacatgtaccttaagtagtgtacaaatgcaggattgcaacctgaggaatttttccattagaaacaccgatattatggatattgaattctctgatgaacgattaactacagtaaatgaaaatacgttgctgtattattcggtcaaggtgaagcgaaaaaatgctaatgaaaaaaatgattctggatggattgcaaggagctatgatgatatgtgcctaaaaaaggcacaagtaattagacgtatttcgagactatttggcgaaaatggttatccggattatgagggtgagcttttttatcgctcccaaattgttcaattaaaaggattgcatggtggtgacagattaaagtcaacattagctctgattatttgtggttatggtgaacgtccattattcactttagcctcaataataatcactacactattgttcgggttgatttacatgtttagtggcatcgatgctggtggaggcgtaattaaatattctctgagtgggagcacacctattttacaagtaatcagtgattatggtaaatgtgtattctttagtattacaacatttagtacggttgggtacggtaattatattccattaggatgtatgagcatgatagtgtcaggaatacacatgcttcttggagttagtttgtgtgcattatttacaggctgtgtttttcgtaagattgcacgataaaacattaggtcctgtttcaattaaggattgtagagcatcatgctataatatcattcttttatatcaatacttacaccggacttgaactctattgtgaagtggtcatcaaatacggttatttttgtagtagtctgcggataatgctttcatcaaacatggtaatctcactgggctgagacttcaagaaatcgcatacctcagtgatatttaaaactgcgtaaacatcattcaattatgataatatctgcccaacggctttttccatgcatactttgatggattgtacttttctgaataaaatccctgtgttcatttctggtaaattgacatctttgatctgggttggggacaattggcttggctatttgaaaagtcctttttaggcgtttataactattttggtatcaagtgtgtctacttccaatcctacgctgcactaatctattaccgcgactaggtacaagaatccatgtttgaatggtgtcgatggaccatgcctgattaggtcgatcgatgatggcattgcgcagcagatacgggcaaacttttgcctgttgcagatgcttagaaagatttattttgggatagattgggtcaatttctatttcggtcatataacgctgggtatgcttgcgaccaatagaatatccagatcgttttaactgtacggatatttgcctgactctccatgtggggttatcctatctgcatggagttggtcaataatcgccttgcagtcccattccatttgaaaaacaggtgttccatgataataaatactggttctattgatgctgagcagttcagcgccagttttaacgggtaattccttgttcttcaaaaggctttttactaaacttgctttcgtaatcagattccaagtgtttctttagattttttagccaatccacctgtatggtggactgattgacttttttagcatatgtttctttttctatacgtgctaaggagaacttctcattcaacttgccgttacactaatcgtcaaaaacagcagaagtattggtaaaaaatcccttcgtccaattgcgaagaagattggtttacatattattttcaatagcaagtatatttaaatctttttcatttaagcaatttgagcaccaagttggatttgaactaagtggaaaatttttcttgtacgtgtcatcataatgaatctttcttttgtaatatttttagaatatcaaattcattataaatgtcttatgaagtgtcttaaatcatgttaccattatactgcgggatgagtaaaactattctgcattttttacatagttattaaatactcatttgcttgttatattgtataatgaatgctaaaatagaagaaatatgccacaggaagactataattaaatataatttgaatatgctaggggtgatgaagtggagttagatgaattgaaacaaataattcaagatttttttcaagaggacacggttactattgtaggttcaggtctttccttggctgaaggtattccgggaatggcaggattggctgtagaattacaatcaaaaattcctcataagttatcagataaattagatttaggaatatggaggagcatttccagtgatttaacctctgggacatcactagaacaagcattgcaacgaaataagcctagcgagtatattgaagaatgcattagaaaaaccactgctgagtttatcggaaaagctgagttaaaggtatttgaaaatgtggtaaatagtaactatgaattaagatttgaagaatatcttaaaaggttcaatattagaaatagcggactcacagttattacaacaaattatgacagacttgttgagtatgcgtgtgagcatcaaggaatacgtattgacacattgtttgtaggaaagtattttgcaagatttctaccagaacaaagtaaatatgcattctgtagcaatattactaaaagagctggaaaatcagttgcactttttgctcctaaggttacaatactaaaaccacatggatgcttaagttggcatatgattgatggtgaaccgtattctataccgggttatccaatgaaagattgcctaattattacaccaggaattaacaaatataaagagggttatagcgttccgtttgatacccatcgtaacaaggccaatgctgcaatagattttgcacaaaagtatattataattggatatggatttagtgacgaccatttggaaacgcatttagtgcagcaattgaaaagtggaaaaccagcactgattttgactcactcattgtcagataaagcagaattgattgttaaatccagtaagcgcgttatagctatttgtaatagtggtaccgaggattcaaaggtgataacttcagccgaagaacatgtttttccaaagcttaatttatgggatttacatacaatgttaaaggaggttttttaatggaacaattattgtgttttgcagaaagtgatttgatgggaagcgtgacctatgttgatacagagcgcattgtcatagaaattgaaaacacaagcattatgggtaaaatgtgtgtgggtaatatcgtagccattgaaacaagtaaaaaacatgaacttttaatttctataattgataaagttacacggaaatatatagaagattttgataatagtggttctgatgttgatgaactgatggtttcatctgcagattatgtgaaggtgagtattattggaacttaccactctgcatatggtgaacggcacgatgtttttaagcgtggagtagatacgtttcctcaaattgaaagtaaatgctatagtgtttcaggaaataatcttcaaaatttcatgaacatattaagcaaggatatagatacggataaaagactaaaaataggatcctttatgatggattcaaatgccgatgctgtgcttgatggaaataaattttttcagcgccatgcagcaattttgggtagtacgggttccggaaaaagttggtgcgttgcaaatatattggaaaaagcaagcaggctcaaatattcaaatattattgtttttgatatgcacggtgagtatacaaaactatctgaaggagcaaataaaattgctgaacgatttcggattgctgggccgggagatttagaaaatccaaaagaagatgtgttgtttttaccgtactggcttttaaatcgagaagaacttttgtcaatggttcttgatcgtagtgactcaaatgctcctaatcaagcatcacgtttcactttgcatattcgcaagttgaaagccgatacacttacaaaagaaagaaaaatagaaacgcttaaaacttttactgtggattcgccaattccgttttcaatagatgatttacttaatttattggtacatgatgatacgcaaaaaggtgttggcaaaaatggcgcacctgttaagggagattgggaaggaaaattaacccgtttcatttcgcggttggaaagtaaacttcaagataaaacctacggatttatgtttcagcctgcaagaatgtctcagaagtatgattggttggggcatatgttatgtcaattacttggatattctgataataaatttggaattaaaatacttgatttttcggaggttccatctgatgttcttcccgttgttacgggtacattagctcgtttattatataatgtacaattttggatggaaccggaaaaacgcacaccatttacgctgatttgtgatgaagcccatttgtatctgccacttaaggatgaagctgatgctgttcaaaagcaagcattatataattttgagagaattgcaaaagagggacgaaaatatggtgtttcaatacttgcggttagtcagcgaccatcagacgtgagcaaaacaattctaagtcaatgtaataattttattgtattgagattaacaaatgaaaacgataaaggggttattaaaaacctcttgccggattcactgaaaagtacgatagacttcttaccgttacttgatgtaggtgaggcactggcagtgggagatgcaatacttctgccaagtaaattgcttttagataaaccttcagtagaccatcagcctattagcgcaacaaaaaacttttgggatgaatgggataacattaagccggataatatcgcagtaagtaaggctgtagaggcgctaagaagtcagagtagataacaatagttgtacgggagctaaacctgattgtataaaggtttagctcccatttttataaatattgtaaatggtataccataggactatcatttattttccagatagtaaaagttgaaatggtatgatagaataaatctgaataaaatacaaagtcgaggaaaaaagtgacaggaaattagtatagaaaataacttttaccgagtattgaaactgtagtgttattggagaagaaaaaccagtaaatcaaaggttttcaggggataagaggaatatgtaggtgagctttttagttggttgaagtgaaatttgtttctcattaccgtggtggataaggaaaataaatatgtgacttgatataagtaaatttgaaaacattaaaatgaatttaacatataaaatcgttaattatgaaattataacaatatttgactatacagctttaattatttagtgctaaggagatctaaatgaataatatatctaggaggcatcatattgttccgaaatgctatttaaagtattttgctaataatgatggtaaaattaaaatatttgacaaggtgaaaatctgcgagtattatgcatctccagaagattctgctgttaggagagatttctatcgagattatttaaaaagtaatgaattaatttgggaagagttttattcaaagaatgtagaaagtagtctgccagaaatatttggcgaaattataaataagagcactcgaataaaatcaacaggaaaaattataacggatgaagttaaaaataaaatgtcattaattattgtcacacagcttttccgtacagaaaagtggagacagtatagttataagtctttgagccctgaggtgctgcttattttaaatagtacaaaagaaaagttacaattgctaaaaagtcgaactggagaaacttatctttctaaagttgggaaggagtcatttgctaagaatcaatatcttgatttaagcaatcatgaaataacattatatactcatcgtcaaatattgtttgatagaagttggattttgattagaacgaagcaaaaagataaaaagatttttacaagtgataaccctgttatactatataatgaaaagctaaaatcatttgaatttgaagataattatataacaaataatagtaattttgtttttttccctatatcaacacagttgttcctgatgattcttccttctaataataaccagttagttgactttgtcgaatatgctgattgtattattgatggtactaaggagttaattgactttcagaaccacggacaaatgattcaagcatttagacaggtatttatataatttttgaacgtttcccctattggatgatagtttgttgatttgtactacactctgaaactagtatgttgctcgagtgaaactttgattttaggcgaactagtgtgatcttttagtgtaacatggagtagtatttttaggaaaagtaatatgaataaattttcttgaagtagagatggggtaatgccgtgtgattaagtaaaatggttttatcttgtgaatatgaaccttgagcgaaatcaaggcaccttgacataaattgataattattaaaatttctgtaacctatgctatgcttatttagaagggtggtggttgaagcaagttacctttgataatgataccttcttttcttaaaagcataatagagtaacaaagcaatgaaaagtttataatggttaaaagaggaaaaattatatgagggatgaatttgatcaaagtacgaaggatatattggccaatagagtaggatggaaatgtagtaatccttgttgcagaaaggcaacgagaggggctggggaaggtaacaacaaatatattaatattggggtggctgctcatatctgtgcagcggcaaagggtggaccaaggtatgatgcaagtatgactaaggcagaacgaaaatctactgaaaatggtatatggttatgccagtcttgttctaaattggtagattctgatttaagcaaatttacggttggtaaactgaaagagatgaaaagagtatctgagaaaatggcatcagaggagttagaaaaacaaaatgtttctagcgagaaacagaaatttacttttataattaattcatataacgatgcagtaacaaatggtgtaataaacattaatttgacaaagtattttaaaggaaggtttttaaaagataaatatgattgggaaatcattattgatgaaataaaagaaaacttacgtttatatctgaacaaagggaaccgatattttgttagattcattgcacactattcagtagcctttataataggaaggttactgaaccctaaagccggtgtagaagttgttccagaacaaagtactaataagggaattgtagtttgggatacaaaagaacatgaggttctatatgaagaattattattagaaacaaaaattataaataatcagtgttcagatgttgcatttgtgttaagtataacaagaaatattcaacaagatgttttgaagtatatagataatcaaaaactttcactgggtaaaatatgtttctgcggttttaaaataccatcaattgattcggtggtagatggtaaacatgcatgggatatcgctaagcagataaattattggatagaagaaagcctaattaatagagagggaattctgcatatatttgtttctgcacctgtatctattatgtttaatttaggaaagatgtcattatcatatggaaaaggtcaaatttatgagtatgatttagaaaatgataaatcaggaacttattatcctgcattatttttttcagaaagggattggatgtagtgtatttgccctaaggggtaaataaaaaatcgtatttatttgtcttttttattgagatgtatagttgggcatatagtataataaaaatgtgctatcgcattgagagatttcctgtatgttatcataatataatcaaatcttaggattatttaatgacagcaaaagggaaaattgtaaaaaggttaatcaataattgaaaaacgatgtgtgtctatggctctgttcagagaaagtgttaatgaatggataaaaagaagtctcaatagaagagttaaattatcaaaaaactattgcatatttagaaaattgaagaagttttttgccggatgcccatcgaaactttaaagatagttctttctgataagtagcattgtgcaatacgatgtaaataatagaaattaaatttatctgaaaaagcaagaaattggaagttctttccggttattcataaaacgcacatcctctagttcataattttttctatgagatcatggcagttgtagctggtgtggataatgcttgcaagaaattagaagattacagcctctcacaggttatcagtcatcctatattgaaaaaacggcagagtgcatgaaggaaaaacaactggccggatatcagttgaatatgctgcaagagcaactgaaagatatgaagaattgaactgaggatacaatcggtaatcaggtgactcatatcaggttctaacctttctgtccaggccggattgcgttttgggactgaatcagaaaacttgatttcggataaacacacggacttaggtattgaatatatatttctcacaacatataatgaataagtatcctacctgacggagacgcagtaatttcgaatcgcatatacataataccagcaacagaatggagcacacagtgaacacagaacaaaagaaaaaatcattactaaatcatcccttacttcaattgttgaagcataacaaaggaaatccaagaacattgatactgatggagcctctatggggcattccatataatctaatcacgccatttgccacactatacatgtattcgcagggagtaacggacgttcaaatcggattgattctgtcgattgccatggtggttcaggtacttttttctttcttcggcggaatattaacggataagctggggcggaaattcacgactatgatgggcgatttcttcggatggagtgttgcctgcctgatatggagtatatcaaataacttctggctttttttaattgccatgctctttaactgttttgaacagattaaccagaccgcatggtactgtttactgattgaagatgcagagcccaaagatttattgggtatatatacatgggtgaatataggcggtttgattgcaatcttttttgcaccgatttcaggcttgctgatcaattcatttaccgtgattccggttatccgggttttatatttggtcttttccgtaaatatgctgattaaggtagcagttactttccgctattgtaaggaaacccggcagggaaagatccgaatggctgagacaaagaatacctctttgttacatatgttatttgaatacaaggagctgattcctaaagtattgaaggataaggaggttatgaaggttctggctgtttctgtcatattatatatcacgaatatggtcagtacgaacttcttcagcttatatgtgacacagtggctgggcatagaatctcgttatctggccttcttcccgattttgaacgcggctgtaatgctgatttttatgattgggatacagcataagctggagcttgtaaaatttcggatacctatgtgggttggattggcattgtatgcaatagcggtgattcttctgatactggcgccagtaggaaatatgctgtttgtcattatttatgtcttcattgtggcagtagcaggggctcttgttatgcctcgaaaagatactctgatccagctgagtattaatgcggaggagcgtgccaggattaatgcgttgattatgtcctttacaattgccttttcttccccattcggctattttgcaggatggttatcaagtattgacagaaggctgccttttgtgtttgcatttgctctattccttgcagcatttattatcgtgggcaggatccgtgatcccgagttctctaagtaattatttaataaacagcattctgtcatgctatgagaattgctgtgggatataaatatcgcggttaaaataatcggctgtatttcatgtcttatgccccgggtattatccgcataatctgaatcaggatgaatatgaagtactacaggcagggtgcgcccatagaattacaccaatcaacaggagggtgaaacacatgaaaaaagctatgctgccgtcacttaacatagattcatggacagaggaagctttgtccgatctgacagcaaaactatcagataataaagtcaaatcacttatactcatcgatggagcagccggttcaggcaagacaactttagcggtaaaactcgctgaacggttgcatgcaaatctggtccatacagacgatgtaagctggtgcgccgatccaatccgctgggatgaggaattgcttgacggtattgttaaaccttggtccgctggaaagaaggccgcgtataaaccaaccggctggaaaaaagagaatcgtccgggagccatcgaggtggatccggataaggcgcttatcatagaaggcatgggagccggcagaaaaacactgcgtgcggcggcagaatatttgatttgggtggataccgagccggaaacagccagggcacgagttgtgcagagagaccttgcaaacggggaaaacggcggaactgttgagtctgtcacagaatttgctgattggtgggattccttattgatgcctttatttttggaggaggagccgtggaaatatgcagatattattgtcagcggatcccggtctgatttaatttctgataagcttatgatccatatagtataagtcctatattgataccccggaataaattttcacccgaattcccccttgcacaaggaggcaaaacatggcagaacaaattcaaaacctggaacaagcagaaaaaatcttagattattggtatgccattgagtttctggcacaggataaattcgatgatatgtgggaaatccgcagtaaatttctgagggcacaggatgcttttacaataagtgtgatgaaatggcaccaacaagatataaaacaccttccgaatatcctcaaaataaaattgaaaaaataaatgaggttgtgaaaacgaaaagacaaaagaaaatgatatctatcatgtaaagaatggagaagagatcctatggatagtacaataagaagtaatattaaaattggccagaccgttaaagtgattcaaaaacaagatcaaagaacgggaaagcaaacggaaggagttgtagaacgtatcttaacaaactcctccaatcaccccagaggaattaaagtgaaattagagggtggtattgtcggaagagtttgtgaaattaaagggtaataaattcgatatcagagggatatttatgcagccagtattgactatgatctgaaagaaaaaagtgtagtgttggatgcactaaactaaattgtaactgcgtatttatccttacctcaaagataagaattcacaaaaaaaccgtctcacctaaaatttgacacatcaatgacacatcctgcaggtaaaataataaacatgtaaattaagaagcaggagtgcaccccaaatgaagccattcatccatcgatttttcacggttctgttaatcctgagtataacagtaaccataataatctattatgcagttaaaatagaaccatacacagttacaataaataatgtgaacctaaataacaacttccctgaaaatcttaaaataatccaaatatctgacatccaaatcagtgaaaactatcaggcttcagatttccaaacaataatttctcaaataaatcagttaagtccagacatcttcatatttaccggagatttatacgagaattactcctcttatggccctgaagaagagctgatccaactattagcaggcatttcagcagcctacggaaaatacgcagtctggggaaatcgtgattatggcggcggagctgtaaggcggtttgaaagaatcatgaccgccggaggttttcaggtcttgtgcaatgaaggagtccatattatgctgaataacggagaacgcctgtttcttgccggattagatgattcactgatgggtaatccaaatatcacgccaatattatcccaaatgaaagaagatgactcctatcgtatcttaatgctccatgaaccggatgccgctgatttatatgcagactatggatttgagttgatgctggccggacacagccatggaggccaggtaaatctcccttttctttcctcgccgacgacatctatggcagagaaataccaaaaaggtttatatgacatggaaacatcgggaaaaataaaattatacgttaattcaggaataggaacttcccattttcccatacgttttcgggttccccctgagataatagtatttgactaaaaacaggaggacagctgtgaatatattaattgtcgaagatgagtctgacatgcagaaaattttaaaactctatcttcagcgtgaaggatatcaggtaaacagcgtttcaaacggacgggacgcaattgatttcctgatcgtgaatgctgtggatattgtcctgctggattggatgatgccgataaaaaacggaatggaaacgctgaaagaaatcaggcagctgaatattccggttaaaatactgatgctgacagcgaagggtgaaaacgcagatgaggccgcaggccttaccttcggtgcggatgattatctgaggaaaccttttgatatacaaatccttctgcttcggataaaaaagctctgtaattcagagaatcatcttcgatgcaatgacattgtcctgaacccagttacaatggaggtaatgaaagggcaggataaggtgaagcttacgaaaaatgaatatgagctcttaaagtatttcctcgccaatcaaaatatgattcttacaagggaacagctgctgaaccatatatggggcatggattttgaaggcgatatccgtaccgttgacaccaacatccgcaggcttcgccaaaaaatcggagaggaatatattcagacaaggatcggtatgggatatattatggagaggcgccatgattaagcagagagtgaaaatacgcaggttatctacgaaattcctttttggcataacgggaattcttgtgctgattttaatagcaaccctgcttattaattcccgaattgcagaacggtattatctgaatcagcagagccggtatgtcaggaagacgggagaacttctgaaagaacgcctgcaggaaggtcaggaagcggataaagtaatagaggaactggaagcttcagaacaggtattgattgtttattctgcaaagtcagacagctatgatgagctgagcatggatttacgaagaaaatttcaggaaaagggattaggctttcaaaaattctggctttgggatcaggattatatttccgctgttcagaacggcagtcaattccgcctttatcagcagaaaaagctgaattatgctattttggtggaatatctgtcttccggagaaaatctgtatgcaatagctgcgattgttcccaatacaggggaatttgtccgaatcatcaaccatttcagtattctgctgtattccgtttccctgttggcagctgtgcttttgatttatttaatgataaggcatataacagaaccgctgcagcaaatggagcatttttccaaaaaaatttccgaacaggattatgggcagctgacggttcagacgcatgatgaattggaaagggtagcggacagcatgaatgaaatgtgtatgtccatccagcaatatcaaaaggaactgttgatgaagaatcagcagatggaacagcttctgaacgatgtagctcatgatttaaaaacgccggtatccctgattggcatatatgccgatggtatcagagacggtttggatgacggtacctttttggaaacaattgcacagcagaatgccaggatggctcaaatgatagagcagcttctcaatctgtcacgtattggccagaagaattatcctatggaaaaaatgaaacttgatgtattgctgcggcagtgtatggaagaacaagaagtctttttgcaggagagaaaactaattctggaaaataatattgtaccaaatgcggagattgacggtaataccgaattaatccgtactcttttttccaacctgctgtccaatgcggtaaagtatgcctcagcatcggacatcgaaataaaactatcccaaaacgaggaaggaacgtatcacttcttcattgctaatgcactggaaaatgaagatttagacatagagcagatttgggttcctttttatgtaggggaagcatcccggaacaaatcgctgtccggaaccggattgggactttccattgtacaaaaaattgccgttcaatgcgggtataagattcagtgcaggaaaaaggacgggaagattatatttgaaatggattttcaataataaataatatagagggtataatcagatactgaaaatatctggttatatcctttttttgaatgatctaataaagcattatttgtgcaaaataaattcccttttgacacacggatgtaatacctgccttttataatcctaaaagtacatgaaagaaagtacagcaaagcaaatatcggaaacaaggaaaggaaaacaactaaaatgagaaaacataattatttccacacaggtatatccgtacttcttatactaagcagtatcctgagcggatgtggaataaaaaactccgtggatgaacccgagagtgagattaatgagcaaaccgtatcccaacagacattgaatcccactatttcaatagattatcaggtagatccggaggatttttccctgattttaaaagatggtgacaatcagattgcagtatccggccaatctcctaaacgaaccgtgtctgatttccgggaaagcgatacggaaacgttctggagatatccggaagagcaaatctcagtttccatcaaaccacaagataattatttaagtgttacaattacctcagaagcagatgacgataacgaatttagctggcccaatatttccgcggacacttattaccttccttttggagaagggaaacgaattcctgcagatgatttgatatggcagaactatctgaatgagcaggaattctccgttctggaacagctgtccatgcccttctggattaccgaagcgggagattattccgtacttttcattatggagaatccatatcgtacgcagatgaatttttcggcgaatcccgatatagccttttccgtttctcatgaatatcctcaaatcgatgatgtaaaggaaaatcgttttcggatctacctgacagacagcaatccggtcagcgccgcaaagctttaccgcagttatgtgaatgaacagggaaatttcaagaccttagagcagaaagcggcggaaaatccggatatccgtaagctttatggagcgccgtttatatatctatggggtgattttgtcctttcagccgataacatcaattggtcggcattccgtaattccctgtcttcccctgtgatggagtatctcctgtctttttcggaagaagcggaaaacggttctgaattcagaaaagtgacagaggaaataaaaaagcaggattatgtggatgtatatcagaaaaatataatctgcggatatatcagccaggtgcttaagagggatgatttttgggatgaatccattttcccatccggcaattcactgaaagggcttatgccggacggctatgaaaacttaaatcagtcagaaaaaatccaggtaaataaacaggcgctggctgaaagcctgccgaacgtttttcaggatgccggacaatggatgaacgcatctaccgtggatttgcttcagagtatgcaggagaatgggattgatcgggcctggataggcctgaacagctgggagcaggcctatgccaaaccggagctgatagaaaccgcacagaaccagggatatctgattgccagctatgattcctatcattccatccatgaaccgggtaaggagcagtggattacagcagaatttacggataagtcgttgtatgaagaggctgcagtcaccaataaaaatggcgaaaaagcggccggatttcaaaatgtgggacgtaagctgaatcctgtgttttcccttccggcagtagaagcgcgtatggaaacaatcatggcaaatcagcttccttttaattcctggttcatcgactgtgatgcgacaggggaaatttacgatgattatactcccggtcatattacgacgcaggaggaggatctggctgccagactggaacggatggcctatatccgcgaccaatatcatatggtcataggctctgaaggagggaatgattttgcggcctccacaatcgcatacgcacacggaatagaattgaagagcttttcctggatggatgaggatatgaaaagcaataaagacagtgaattttacattggaaattactataatccgtcagggggagtggcggctcatttttccaaagtaattcctttgaaagaaaagtatgatactatttttgtggatccccggtatgatgtgcctttgtataaattggtctataacgattcggtcattacagcagctcattgggactggtcaacattcaggattcagggagcggcgcaggatcggatggttcgtgaggttctctataatgtaccgccgctctggcatcttgatgatgcggaatgggaaaagtataaaactgccattgccgatcatttttccgtatggtcggattttggcaggcaggctgtgcttctggaaatgactgatttcgaatatgtaacaccggaaggaagcgtacagaaaacggtatatggcagtgaactttctgcagtagctaactacagcgattccgtatatcagtatgaagactccgagattccggcgcattcggtattgataataaacggaagggaaaataaaatttacacaccaacagcagactgatacagcagaaaaacggcacatacactgccgttttttctgttaatggaattctgcagaatttaaaaaccatctgtactgctgattcgtaatttagatattttattgttgcctgtcctggtatataatggaaaatgtacaacagttaatttctgtatagaattaagattagactttcacacaaggagttcatacagcatagaaattatacatgtgattaactgttaagagaaaccgaaagggtaatggtaaaaaacatgggtgatatcaataatcttatttcctacttctgtgaatatgatttctacaataatattctttctgcagaaataagagataagagggctattgatgtattattggaaaactgtaaatttccttttctgtctgccaaaatggccgaaagaaaggcggaacaaatccttcagatcttaagcggtaaactgcccctgaataaaaagcaggaagggaaaaatttgatcagagagtatgtggatcaccgtatttctctgcaggacttgtttcaaaggcttccttttaccactcagaagtttctgggtcaggcaaaggaggaggtcaacaaaatagaaaataatcatattttttatattttttatcccgtatatctgaatcggagaaaacatacccagcagccattattcacattcacctgtgagcgcctggaagattcgtatcgaatacagaaagtgtatgccaacaaaaatatcctcacgctgcttgttgctcagaaaaacgatatggaattgacagatgcgagagttttgtatgaaaagcagattgatgaaatgtccgctgctgtggatgcgctgcatccggaagagagtatcctgaacttatatcagacggtaagcggagaattcaggcatatttttggaacgcagttacaggcatgccaggtttccggggactggcagatgttggaaaaggctctggtctcttttgcatcccaggatgcggtgattgaaaactgtttccgggatgagatggaaaccatggagcggttttacagtcaggatggcattctgccggagactgtgcagcagtacatggggatttccgggaaaagtgcggaagatataagcggaatttcctttcatggaagccatcttggaagttatcaggcggaatatccggttaatcggaaacaatgggaattggtgcagatggcggaaaagtcaacgctgctgtgtgttgaggggcctccgggaactggaaaaacgacgttgttgaaagaattgattgcagatacattggtaaaaaaagcggatgcattattagaagtatgggacaaaccatggatagatatgggggcagaaggaaagaaaatcaagtgttctccgctcgcgggaaaaaatccgtattctatcgttataagcagtacgaataataaagcaattgataatatcggcttggaattattgcgggaggtggccttcttttcagagtgtgccggtgaaatcgaaactgatggagcgaagtgtgcaggtattttgtgtgccagacttggaaacagcggaaatatagaagatttttacaattcctttttcaggccgttctgtgatttcctggaaaataaggagattacgcaaaaagaggcggaggccgtaaaggaacactatatggaactgcgcacgaagatggatcggacttcccggaaaatgacagaatttatttcattgcgggaaaagtttgaagactgttcttccttaaaagagctgtgggaaaaacagcagtatatagaaaaggagttcagcaaaacagctgcgaaaataaaggaagaagagaagaactattccgattgcctgaatgaaacagcggaattgaaaagaaagaataatgaggctgagcaggaaaagagccggttggctaagcaaaaagaagaatcggagaaacagctttccgcactttattctgatttggaggagtatgaaagcataaccggggtcaaaaagatgtttattttcctgttccctgcggcaggagaagtgaagaagaaatatggttccgcacaacagattcgcgatatgatttatgaccggaagaagcagcacgagagtctggatgggcggatgaatgagcttgttatggaggcagcccggtcaaaggaaagacaaggaatacaggaaaaagaagcggccgctattcagacggagctgctgaagaataagtcccacagtgaaaatgtcagaaaggaacagcagattctggaggcatatttaaagcttctttcgatgctggagcaggaattggagatttctgcagaacagtgtctgaaagcagaggcttttatgttctttagctgtcccaggataatcaccatgagaaatcagctttttatggcttctctgtctttatttgaaagctatgtccttaggaataaagagcctgtattggaaaatctgaatattttacttactgcccaggagaggggagatggaggggctttttataattggtgccgggctttatataatggagatgcggcatataaggaggagaaagccgcattggttcgtatgctgtgggagacgttttttctgtgttttccggtggttaccacgacactgcattccttccggaaaacgacattccccatgattcccggactatttgatatgcttttgattgacgagagcggccagattgttccttattatgcactggcgccgctgtatcgggccggccgggcggtgtttgtgggggatgtgaatcagattgaaccgataaaaagtgttccctccagcctgctggagaagaaatatacagatttgctgggtgaggattgttatgaaagattctgcctggatgctgccagtgcgcagagctatgcggcaaaagcgagtgatttcttcgagatggtgggggatatacgccagggggtgatcctgacggaacacagacggtgtgagcctgcaataatggctttttctaataaatatgtatataaccatgttctggagctggtaggtacggatgataaccggaaattgttcggcagtaatctgacggcctttgatatcagaggctttaaggcggcccagcattataatgttgcggagattcaggcatgtcaggagattgtccgtattttcgtcagggaatacggggaagaggtaaagaaggatatcggtatcatcacgccgttttcaaagcaggcggaaatgctgaggaaaagtattcccggagtggaaacagggactgtacatgtatttcagggagcggaaaagaaatatattctgttctcctgtgtaatcgatactgcagaaaatgattcgggactttgtaattttatcggcgggaagtgcaatctccttaatgtggccttttcccgggcaaaaaagcagttcatatttgtgggaaacctgtctgcagcacaaggtaagaacaattatttgaaaaaagcggtggatgtgataggggaatccgggaaaatatacagcctttttgatacggaccggctgtccggtgaaaatatgctgtgggatgaaaatatcatacatatattatccggagaacaaaagctggctgaagaggatgaaattggaagatacctgaaggaagtgattcctcataacatcattgatacgccgcggctgcataatgagatattgaatgaaatggttttaagggcggtacagagtattcagattatatcgccatggattggacggaacgtggtaacagacaggatgctggaggcgatacgtgataaagtagagaatgagattcaggtccggattatatttggttataaggcggaggattgttccctggaggatatcgacaagttggtgcagcaggatattccatgggaaaaagaggcatctgcggatgtaataagaaagcttcggattcttctgggcgatgggctgaaatatgaaccgccaacccatataaagctgcttatggtggacgacaggtatctgtttatcggttctttgaattggctgtataacagcgggaaaacagagcggaaggaaatcagctgcctgattaccaactcagataccattcaatatgtgaaggagcgttttttaaaccagaggtaactgttcagaacccctttctgcctgtctgtatccccggcgtttgggaggcagaaaggggggttttattcggatagcaaaggcggcagttttgatttcactttccgggccgccgcttttcgattcatacatattacaggtggcattgactcagcacattcctgcatttcatcgaaatacatcatcctttatcatgccatctcatcccgaagggcatcaataatattctccttctttatcttgttaatcgtataaagcatcgtaataaatacaataaacaggactccaaacacgctgatcccgatacttccccagggaatcgaaaatccgacttcatccacaatcattcccctgtgaaccagccatgcggcaaatactgcgatgggaaggccataaagcagcgccctcattccataaaaaatgcattcaaaattcatcattttctggaaatcgtgttcagacattcccacggaacggagcatggcgagctcccgcctgcgcagcttaatattcgtggaaatcgtattgaacacattggcgactgcaatcatcgaaatcataacgatgaaggtataggcaaatacattggctataaaaatataattcctgttttcatccatcatttgatacatattgtaaagactgtattctcccgtaattccttcaccttctataatagtctccatttccgatgccgaaagagagggatcggctgactgaaagcttaaacttttcacgccttccgaagcatccgggaattcaaaggtaccttttgcagaataaggcgcgagcacctggaagcaggcctgtttctgtccggagtttcctcttgccggaggagaatccggcggtacgaaattcacaaaggcaacatcgatatttttgctttcggacagcttttccccgctgtcggtttcaggaataagagtaatttttacagaagaattcctgaaaacagtaaggatacggtcatcctccgccgtcatggaaacggcaataaacttcgcattttctccggtatactctgtctcggataaccccagctctttgagaatattctcataccggctgtcttcaaggaactgtatatttacgggcagatccacgatttcatctgttgaactcaggccttcatgccgcagataatcttcggaaagctcaccggaaccggcagcacaggagtaagccataacttcctgatacaaagcatcatatacacctcgggcagttttcagcttctcataaagcgaaagcatttgcccgtcatccagatcctgtgtggaaaaaataatatcataatccgtaatctctgtccgttggctcgacattcgtttcatatcagccgtcaaagcgctggtggaaatgaacaggactatacttaaaacaagggaaagtataatgctgcggtatctttttttgttccttttgaaatttttcagtgcaagcgttccttccagaccataaatacgcatggacagcctggaggtttttacggttttggattcgatttttacctcgttcgtctggcggatgcattccatcacaggtgtattggcggcctttctggccgggatatatgcagaaatcaggatggtaagcaggctgactgccgccgcggcgatgagcgcgggagcggataaggtaagggtcagaggaacatcccggaagaggatgctggcaaagttttgggaaataacggaaatgaccagtccgatgctgatgattccgaccgcgataccgatggggatgccgattatgcctatgcagaatccttcaaacaataccgaattgcgcagctgctttgccgtggctcccacggaagagaggatgccgaactgctgtgtccgttcattcagtgacatgttgaatgaattatagataagaaaaatggatccgagcatgatgatggcgatgacaatgccccccatagagtacatgaacatattgaacaggttgtcatcggaaattcccatgaaacgcagtacgttgtcattgaggacgtaagcatgttttccggtactgtttatataggcgcgcacctgacgtggatttttcagggtgacaaacaggctgaagctgtctgtttcggtgcggtcatccgctttggttatcaaagtatatcccggagcggaagcctcctcgtaatcaggcctgcggcaggtaccgacaacggtataggttttctctgcctgcggcacgaacgtttccctttcggcagcatagggatcgccttgagacagcttacggtctccgtccatgcggttccctacggacagggaaagggtatcgcccaccttgaaactgacaccgccgtcagacgcgactttgctggaaatcagaatttccccgctgttttcgggcagtctgcctgaaagcaaagtgatgggaagcgcagcaaaggtttcatcggtgaagccggctatgaaaaggtagggtttatccggattttggccgccgccaagcccggcatagccgatattgtcaaaaactgctgtggcagcaagcttatcattgacggcctgttcccggataaaagaggagtcgacgtccaaaaacgcggcatgccagtcaccgtatttggaaatggatccatttatcaaataattcagaagggaaacgccaaaggtggtgactgccgttaccatggcagcggacagaatgactccgacaatggttacgagggtccgggtacgattttttttcagtccctggagggctaccttgttaaagatattcatgagcgtgccacctgcctctcatcacgcaccacttttccgtccgcgatgcagataatccggtccgcctggagcgcaatattttcatcatgtgtgacaatgatgagtgtctggtgatatttgttgtggctttctttcagaagatggatgatttcctggccgtttttgctgtccaggctgccggtaggttcatcggcaagcatgacggcgggggcattcatcagggcacggccgatggcgacacgctgctgctgtcctccggacagctggttcggcagatgtgttttgcgttcctccaggccaaggagctctaacaggtcattcagccgtttctggttgactttgcgtttgtccatgaggatagggagggtaatattttcttccacattcagggtcggtatcaggttatggaactggtaaatcaatcctacctggcgtctgcggaaaatggcgagcttttcattgctctgtccgtatacatcctggccctccaggtatattttcccgcttgtagggatgtctacgccggcgatggcgtgcagtagggtggatttgccggagccggaggaaccgatgatagcggtgaattcccctttttcgatagtaagtgaaatatggtcgagcgcggtaacctggttttccccttttccatagaccttgcacagctctttaatttttaaaaactccattatatgtgtctcctttcgtagttcatagccatataatagaactttcagcttacattccggtgacttttcggtgagagatccgtcactttggaaaacggatgacaaacatcgcgccgccccggggatgattccgggcggtaatggatccgccttgtcttgtgattatggtccggcacagcgccaggcctattccgtatccggcggtactggaattttgcccccggtaaaaccggttaaaaaggtttggaaggtcttcttttttgaagccctctccgctgtcatgaattgtgatttccgtaaaaatgggattgtcctcacaatggatatcaatttttccattatcgcctgcgctttccatgcagtttttgaagatgttctgaagggcttccgacagccagttgaagtccccttctatggttattccgggtggtacatcggcctgcaaagagatattatgaagctccatggggatcagaagagggcggagtgcggcagtaattaagctgtttatgttgacttgctccttctgaaaaaccacaattcctgcatcaaggcgtgataatttcaaaagggaagtgagcagccagtccatccgtacaagcagttcctctgtttcccttatcagatttttccgttccttttcatcagatgtattttctattaatgacaggacgagggttatcgatgtgagaggagtccggagctgatgggcgacatcagcaagggagtctgcaagatgctccttttcttttttcagagcgtcgttttgttcccggatacgcagcatcattttagtgatttcactttgcaggatggaaagctctccttcctccgattccgtaataaacagatggtcggcattatgaagcacgagatcaatctgctcggaaatctgcataaggcttttgtatctggcttttgtaaacacgaagaaagctgttccgaaggcaaaggaagaaaacagggcaagaatccctgcggctatattgttggcgaaccccagcgtcacagaagcagcggctattaaaaagaagatgacggcgaactgccgaaattccctattccgaagcatttccatcccccaatcggtatccggttccgcggacggtcagaatgatctgcggattagcgggatccttttctattttttcccgaagccgtttgatgtaaacggtgagtgtgttatcatttacaaattcaccggcggcatcccacagttcatcgagcaggcggtttcttgttataataattcccgggttgttgataaataccagcagcagccggtattccagggcggaaagaaaaacgtcgctgccgtcttttttgacgacaccgctggcagtatcgacatggaggccgcagatttcaaaggcggatgtactgactccgcttttgcgaagggcggttttgattcttgctaccagttcgcggggacggaaaggcttggtgatatagtcatccgcgcccatattcagtccggtgacgacgctggcttcgtcgccggaggcggtcagaaagatgacgggaatatcctgcgattctttgatttccgtgcagaccgtaaagccgtttccatcgggcagggagatatcgatcagcgcgagatcgaatctgctgccggcgagcgcggcaagggcctcgcgtcttgtgggggcgtgggtgacggtgaatccttccgagcggagcaaaaggattaggtttttggcgattgtaaggtcgtcttcaagtaagaatattttcttcatttcttcttcctatcttttttggggtgggtgattttgcgtagggtgtgagtatgcccctatgcccgccggttccgtgtctgctgcccgtaggggtccccgtgctgtcctccgccgtccccggacatgcaagggtccttgcaggggaaacgactttagtcgtttttgcttatcgctcggataagcacgcagcggtactaaggctgcaaaggacgcagcctaaggaccggcgagcttatgacgccccttacaggaacccttgcatgtccggggacggcggaggacagcacggggactcatacggacggcagacacggaaccggcgggcataggggcatacgtgaaggttgcgtaatatgagccaaaaatcatttggctgatggtcttattatatttcttttgatgaaaatatacaatgagcataaaaggagggggaggatatggagggcggttgatgggcagattggattttgtgtggtagaatatagaaagtatgtgaaagagatggtttgttagatatttatagggcaggggtgtggagatggttgggatttattttagtgggacggggaatacaagatattgtgttgaaagatttttggcgtgctgtggtggggaggcggaggcggtttctatagaggattcgcgggcggtggaagcgattcgggagaatggggtaattgtttttgggtatccggtgtatttcagtaatatgcctaagattgtccgtgattttatggaagagcatcagaaatatttttttggcaaaaaagtatttctgatagcaactatggggttgttcagtggagacggaacggggtgttcggcaaggctgttcaaaaaatatggagcggatattgtggggggagttcatttgaaaatgccggactgtatcggggatgaaagggctttgaaaaggacagtccggcagaatcatgaactgattgaagcggcgggggataaaataaaaaaggcggcggaagggctgaaaggtaacaggcctccgagggaggggcttggttttgggtatcatgcggcggggctgtttgggcaaaggctgtggttttatggtaagacgaaggattatacggatagggtgcatgtggatgcggataagtgtattggctgcggaaaatgtgtttcgctgtgtcctatggataatatggaactgcggtcgggaaaggctgtccaggggggacgctgtacgatgtgttaccggtgtgtaaatcattgtccggggcaggcaattactttgctgggaaagaagctgtatgagcagtgtacggtagaaaaatatctgtgacagcagcccggctggggggacgcgggttgatggtagtcgggaaaagaggtatcagggcaatttctgaaaaagtttgtctgcggtaaatatggcattcaggactttggggaaaccggtataggggatgcactggaggaaggtctcaataattttttctttggaaagtccgacatgcagggcggcggaaatatggacttccagctgcggttcacatccgcctgcggtcagcaggctggcgagggtgatgatttcccgttcctgcagtgtgagtccgggtcttgcatagatatcgccgaatgcgaattcgacaatgtaggttccgaggtcgggggagatattttccagggatcggatgacagcgtctccgccgtcaccgtcaattttctttaaattctccattcctgtctcaaatcttgttttgttcatttctttttacctcctggtttgatagaatatatttggctgcaggaaaagaatagttcttagactatagtcgaagtcaagagattttaaaaagttgcttgaaatttaggttaaaggcgaaaagaggttttgtaagtgataatcggagaattttcccgtttgacaggaatcagcgcatatactctgcgttattatgagaaaaaaggattgcttcatgtggagcgtgatggtgccggaaggcgggattacagggaagctgatgtggaatgggtgaaatttataaagcgtcttaaggatacgggaatgcttctgcgggacataaggcattattcggatttacggtaccagggggataaaaccatggaagagaggatggaactgcttgtacggcacaggagaacagtggtggaggagcagaggaaatgggcggaatatctggagaacctggatgataagattgagatttaccgggagcggattgacgggggaaggggataacaggggagcatatggcaagaggattgttagatttattatttgacagtatttttgatgcggactggaaaggccggtatggagaaaagctgaccgagagggaacttaatctcgtgagactgttcgggcgcggcgggaaggtgctgcgtaatatttatgtaccgaaggataacggggaaacgtctgaaatagatgttgcctttctgacgcagaagggtatctttgttatagaaagcaagaattattcaggatggatctttggggatgagaaagccgcttattggacggctatgcttccgaataaagaaaaaaaccgtttttataatcctgtctggcagaacaggacccatataaagtggcttgaaaaatatctggatgacgagatccctttcttttccatagtggctttttcagaaaggtgtgaattaaaaaaagcagtcatagaaagcgccgatgtccatgttattaagagggaacagttatatgctgtcgtgagaaatatatgggataattctgcggataagctggatgaggtaaaaattaacgccatatatgaaaaactcaaaatattaaccaatgcagatcaggcggttaaggcggctcatattgagaatattaacagaaagtataaaaagactgaaagcccggacagcttgaaaataccggaaccggccgggcctcatgaggatacattaatatgtccccgctgtggggaaaggcttgtacttcgtgtcgcaaaaaagggagccaatgcaggaaaaaatttctatggctgttcgaattaccctaagtgcagatatatacaaaacatagattaattttactggaaaagatagttgctgtgccggaagagcggaaaaggcataatcctaagaaactacatcatgcttttcaccacttcaataaatctgagcacttcctccgatgcatgaaggctgtacagcagcccgtaaggaatactgtagtcccaattcacgggaatcgtaacaagcccggggtggacttcctgccagcattcaagagtgagcagtacattttctgtttctgcgcagcggttaaatacggaaaggtcataaaactggggcgtatcttcaatttttatctgaggatgatttttttccagatcatcccggagggaatcaaggatgccggaatctccgcgttcggtcatcatgatggtttcattatacagatcttcgatattaatgcatttttcggcagcgagatgatgttctctcgtcaccgaaaccatttttttatatcggccgagttcgagaaaattgcagtggcgcagccattctttcgaatcgcagacgccgatcagaaagtcaaatttctttcccagctgttctatttcactgaggattcctttatggttatccacaaaggtaacgaggtgcagcttatattcggagaaatatttatttacgtggggccagagatccataaagggtttggcagggttcaaaagtgaggtgccgatgaaaaaggttttatccttggcatgaagggccgcttttgcatttgtaatggttttctgcgaatagtcgattataaatctggaattctgataaatgacagaccccgccgctgtcagacggacaccggatggtgtgcgttccaccagcttcatatccagatgttcttccagcgtatttatctgtttcatgacggcggttggagaaatgtacagacgtctggcggcttttgtaaaactgccgcagtcggctactgctataaacgtatcaagtatatggttatacatgtgtgacctccggaaataaaaagaaacctggtcaataatcctgtgatgtgtgtccggtaaggtataaacctaaagttgatataatgataccataaaggagattctaaagcaagaattcaggatatataatacatgtattaaaaaaataaggaggtaaaaaaatgacggaactgattgcatttttttcgcggggggatgaaaattatgtggatggagagataaaaactctggagacaggaaatacggaggtagtggccggcgttattcagaaattaacaggagcggagctgtttaaaatagaacctctgaaggaatattcgaaagattataatgagtgcattgcgcaggcgcagtctgatcagatgcagaatgtgcggccggagttaaaggcttacccggagagcatcgaaccctatgaagccatttatcttggttttcccaattactggggaacgatgccgatggcggtttttacgtttctggaacattttgatttcacaggcaagattatcaggcctttctgcacacatgaggggagcggaatggcggactgcttaaatgatcttattaatctgtgtcctgatgcaaaggtggaagaagggcttgtgatcaacggaagccgtgtgtataagtcggttaaggaaattgaggattgggtagcggcggtaggaaagatcagctgataacagggtgacagaaagtccgatatctaaaagtagagacagtctgatagaatgaaggcaatcagactgtctttatttatctagaaaaataaccggatttgatacctctttctctgaacatactccaaagccttcctataatttaggccgtgccttcacactattaataaaatgcttcgcagcattacccagttccttcttcttggaataagcaaggctgatagtagttgtaaagcatggtgtcacatcaactatagaaatatcagggcctgccagatacacagcaggttttttcgtgagaagagcaactcccatttcctttcggaccagggagatgatattttccgcccggtatccggtaaaagcgatattagggcggaaaccggcggacttacatgcattgacgcacagcgtatgcatgagcgtccccttatttaaaaacagaaagttttcatccttcagctgctctaacgaaatagaagaagcagaggaaagcggatgggaacttggaagaacagcgaccatatgatccgtcgtaaaaggtattttgacaaattcattgtcggaatcatcatgttcacggataaatgcgaaatcacactgctcgtttctgagcatttctttcagttctgaagaatctgcctctataatatgtactttaaaattcctgttttctctctgaaaatctgcaagcacatccgtaatatgatattgagccatcactggtattgccccaatagtgatggtttcggagatattattctgatggttaaaaagcgcggtagtataatcatactgtaaattcataatctgttttgcataaggaagaaagatttttccaaaatcatttatgacaacttttctggtggtacggtcaaaaagcggcgcaccgagatcctcttcaatagatttaatatgtctggagagcgtagactgagagataaataagatatcggctgcttccatataattaccgacatcagcaagtgttacaaattcccgtatgtaatcaatttccatttcgatataccccactgccattattgcataacctgcattaattgtagcggggtatgttaaatgtgtcaatagaattggcagaaatgagaaaaatgtgagcgagttgcaaaagttaaaaagcgcacaataaaagtatttatgcaaaaggtgcataaattcaagggaaacatggattgcttgagcgggatgcacaaactataatggccttatcaaaagaaatgagaaaaatcacgggagaacagaaatgaaaccatcattagcattcccgattccgcacacaccggaatttgatgtgaatcgtatcaaaaatatatcagaaaaatatctggatatttcctatgcttctgaaaaggaacacgttcttgatttatatttgccggagaaaaagaaagaagagtatccgctgatcatctacatacatgagggagcctttatctttgggagcaaacgggataaaagaatggaaagtctgttcacagcgctgcaggaaggctatgcgattgccagtgttgattatcgaaaggcagatcaggtgacctggccggcgccgatttatgatatcaaagcggcaatccgttttctccgggcacatgcaggagaatataagctggacaagaaaaggttcactgtctgggggatgtcggcaggcgcttatttgggggtgatgacagccgttacgaatcatatgcagtggtttgaggacagttccatgggaaatccgcatgaatccagtgaaatccagtcagtggttgatctatgcggagcctgcgccgggtttcatcggctggatgattttatagaggagaatggatttggaatagcaaatcataatgaggcaaattcaccggaatcaattcttatgggacagccattgaaggatgcaagggaattatgcaatatggccaatccgattaattacatcagagaagacattcctccgttttttgtattacattgtctgaaggatccggtagtgccggtacagcagtcacggcttttggtagaagaaatcgtgaaaaaggcgggggcggataaggtaactgcgatttttacggaatcggaagcggatcatggaaaaccggattatgatacccgctcgatcgtagatgccgcacttgaatttttaaaccgatactaaatgcatggtgcatttattataaaaacaagaaaagggagaaggaaaatatgaagcagaaagtattatcactttttttagccgcatgcatgacagccgcactcgtggcaggatgcggaagtactaagaataccgctaatatggaaaacggcggtacagaaggcagtacggtaagcaatagtaccgaaagcagtacacagacggctgacacagcagcttctgagagcggggattatacaagagccggaggagagggggaaattgttgtcggcatcatctcggatccggaaaatatgggaccatgggcgggcatgtctcagggacgtattgccatattgaataccgtctatgaatatctgattaccagagaaaatggtgagacaaaaggggttcttgcaaagaactggacgcagatagatgatactacttatgaagtggaactttacgattatatccatgatacagaaggcaacccgattaccgccagtgacatcaagttctgctttgacagtgcactcgcaacaaaaaactacagtaagctggaagtaattgacagtgttacggtactggatgattacaaggttgaatttaagttttcaaaagctctggcagtgggcgaacttgaaaacgtattcctggaatgtgcgatagtttcacaggcggcatatgaggcatccggtgatcagatggccgtcgatccggttgggacaaccgcctataaggtagaaagctatacaccgggttcccagctggtactcgtgaacagcaatgattattggcagacagatgattctcttgtatggacaaccagtaagcataatgcagataagattaccatgtctgtaattacagaagcttcccagcatacgattgcaatgcagacacatacagttgatattgccaatggtgtgccggatacggatgtcccgaaattcgacgagggcggagaatatgcagacggaaatgaagtagaggttcttttggacaatcttacctacgacatcctttacaatatgtcagccgattctgtttttgcagaagatgaaaacctgaggaaagcaattgcctatgccattgaccgggaaggcctgaataccggcgcatttaatggaaatggcgcggcagttaaggattttggcaatgcgacttatcctgattacaataaggaatgggatggagaggactattttgactacaatatcgatacggcaaaggattatcttgcaaaatcgagttataacggacaaagtctcagactgatgtacacaacttcaactacggcggatatgattgcgcagatggttcaggcctatcttggaaatatcggggtgactgttgaactggttccttacgagcagatgtcctttatcgcatctcagtttgattccgctgcatacgatattatgctcagaactaccggatcgacggactacattgtgaatcagtggaagctttgctggtattcacctgactttgagtcaacaaccggaggcacagccaactttgtaaaggacagtaaactggatgaactgatggcagcctgtctgaatgtaaaaacatatggtgaagaatctatcgatgcatttcatgattatctggtggaaaaatgctatggatacggcattgtggaaggaacgattaattccgttcattccaaatatataaccaaggttgcgctggacgacagaaatcagattcttccgggagcctgtgaattagcagaataatatttgtatatttgcggaggcggcaaatataagacgtacggtactgccgatgcggaaagggatgcacagagggcattccttcccgctgggagtgccttttttcagaaaggagctgcgtatgtggaaatatatcgtaaagcgtttgttgtggatgattcctgtgctgctgggaattgcagttgttatctttaccatcatgtatttttgtccgggagatccggcggcgtcaattttaggaaacggtgcgacaccggcggcgctggaggccaaaagagcagagatgggtttggataagccttacatagtccgtttgctgaactatctgaatcaggtttttctgcattttgatttgggagattcctattttaccaatcagtccgtcatgtcgggaattttgtacaggatgccgtataccatcaccatagcggtaatctgtatgcttcttcagattctcataggtactccgcttgggatcacggcggctacccatcagaacgggctggcggatcgcttctgcatgatcgtagcgcttctgggagtatccattcccggcttctggctggctatgatgatggtaatactgtttgccgcaaagcttaactggctgcctgcttatggagtgggaggaatccagtactatattcttccctgtattgccaatgcgtttgcgggaatcgcctctcaggcacggcagacaagatccagtatgctggaggttatccgttcggattatgtggtgaccgcccgtgcaaagggcttatccgaacgggatattttatataagcacgcattgcctaacggattgattcctattatcactgttattggaaacggtatgggtatgatgctcggcggtacagtagtcattgagtctgtattttccattcccggaatcggttctttcacaacgaaggcgatcaataacagagattaccctattgttatgggcggcgtcctgtttctgggggcaatcttcagcctgatcatgttaattgtggacattgtttatgcctatgtggatccccgaatcaaggctcagtatgaagggcagcagaagagctggaaaaggaggaagaaataatggcaaaaacagcggcagtcggatgtccggcagaagaaaaaggccggagaaaaaaggaaagtcagttttcccaggtgctgggaaggcttcgcagcaacaaaatggcaatgttcggcctggcaatttcgctgcttcttatcgttttggcgatagcagcaccgctgatcatgccctataaatatgatcagatggatatggcaaaccgctttgcgtcgccgtccctgaagcacttatgcggaacagatgaaatgggaagagatattttttcccgattgttatatggcggaagggcatctttgcttttgggattcaccgcaacaattatttccacttttttgggaatgctcattggctctgtcgttggatatttcgggggaacggtagatacgattgttatgcgtttgattgatattcttcaggcgatacccggaatccttcttgctattgctatttcagcatgtctgggaagcgggcttttcaatacggtgctcgccctttctattggcggcattccgatgacggtacggcttctccgcggttctatcatgggggtacgaaagatggaatatattgaagccgcacaaaaaataaactgctcagtacccaggactatcacgaagcatattctgccgaacagtatttcacctataatagtgtccgtaacaatgggaatcggaaataccattcttatggctgcttccttaagctacatcgggctgggaattcagccgcctacccctgaatggggagcgatgcttaccgcggccaaccagtatatggtggatcatcctcatatggttgttttccctgggatagccatagcgctgattgttctgtccctgaatctgcttggagacggactgcgtgatgcgctggatcccaaattaaagaaataggaggagaaaataatgacggagaagaaagtgccgtttatagaagtaaaaaatcttgttgttcattacacctccgagggacgtgagatccatgcggttaacgatgtgtctttttctttggaaaaagggagaacgctgggactggttggggaaacaggagcgggaaagaccactattgccaaatccattctgcgtatattgccggagccgccggcccatgtggatggcggggaaatctgtctggaggggaaaaatcttctggaacttcataatgatgaaatgcggaaaatccggggaaaacggatttccatgatttttcaggatcccatgactgccctgaatccggttatgcgtatcggaaatcagatcgccgaaggaatagagcttcatgagaaatgttccaggaaggaggcggaagcgaaagcggccgcaatgctggaaatggtggggattcccggtacgcgtttccgtgattatcctcatcagttctccggcggtatgaaacagcgtgttatcattgccatggcgctcgcctgcagtcctgatcttttgcttgcagatgaaccaactacagcactggatgtaaccattcaggcgcaggtattggatatcatcaagacacttcagcaaagactgcagacggcaatgatcatgattacccatgatctcggtattgtggcggaagtatgtgatgaagtggcagtcatctatgccggtgaaattgtggaatatggttctaaagaagaaatttttgatcatccgtcgcatccgtacacgattgggctgtttggatccctgccggatatcaactcggatgtggaacggctttcccctatagcaggcatgccgccggatccgggaaatctgccggagggctgctccttttccccgcgctgcccttatgcatcggataagtgcagaaagggagacgtaaagctgataaatatcggaggaacccatacctgccgctgtatccgcgcagctgctgcggaggacaaaacagctttttcagacggcggacagaaaaagacagccgaaaaggaggcataacatggcggcaccattattagaagtgaaacatctgaaaaaatattttaatacgccgaaggggatgcttcatgcggttgatgatgtaagcttttccattgaaaaaggccggaccatgggagtggtaggtgaatcaggctgcggaaaatccacattagggcgtacaattatacatttacaggacagtacggacggtcagattttttttgaaggaaaggatattacaagggttaaaaagaaggagcttcatcggattaatgaagagatgcagatcgtatttcaggatcccttctcttcgctgaatccgcgaatgactgttgaggaggtcatcgcggagcctcttgaaatttcccatcggtttaaaagaggtgagatacaggatgaaacagaaaggattatggagcttgtgggaattgatgaacgtctgcgccattcttatccgcatgaactggacggaggcagaaggcagcgtgttggcatcggccgtgcccttgccctgaatccgaagtttattgtctgcgatgaaccggtatcggcgctggatgtttccattcaggcgcaggtattgaatctgctgcaggatttacaggaaaagtcgggaattacctatatgttcgtaacccatgatctttccgttgtaaagcatatttcggataatatttgcgtcatgtatctggggcagctggtggaaaccgcgtcttcaggcgagctgtttgcccatcctatgcatccatacaccaaagcattgctgtcagcgattccctccattgatattcatcatccaaagaagagaattgtgctccagggagaaatcgtatctccaattgagccaaaaccaggctgccggtttgcagccagatgtcctcatgcgacagaagcatgtcatgaaccgcaggaactgaaagaaatctccgcaggacattttgtttcctgctgcagggtgggtgacaaataaaatatgggtgcgtcaaagcgcacagatgggagcagaaaatggatagaacaatgcgggcaggcgctggtaaagaagaaatcatgctgatggaagcttatcttgcaattgaggatttttccattgtacacagggcgctggatgtaagggctgtaattattgaaaatggcacgaaaatggcttttgtatccgttgaaatgacttcccttcctgcggaagagatagaagcagtcaaagacagaattgttatggaggcggagatagagagggagaatatatgggtgtgctgcactcatacattttctgcaccgcatcttcttccggatttcatgctggcggaaaatgacggcatcgccaaaaaggaggaattcaggaaggctcttcagaatgcggctgcgacagccgttataaaagcacagagccgtatggaggcggttacaccgcggtttggcagcagttactgcgatatcaacatcggcagggatgaagaactggaggatggctggtggattggcgaacacggcatggggcttgtggatcatgaaatacaggcgcttcggctggacaacagggaaggaaagccggtggcagttatttttaattatgcgattcagtcttccgtattagatggttccgttttaagtaccggaggaaaaggcgtatctccggatgtcgcaggaacagcctgtgattatatagaacgttgttatcgaaaaccgcacccggttgtcttattcctgatgggggctgcaggggatcaggtgcctgtgaaacgcacggtttctgaaacatttgtaaagggggaacgtgttcggaaggacagacatgaggaaggctttaagatttgtgaggaattaggaagaacactgggagatgccgttatccgggcaatggattcctctcggcaggtatccgtggatgatgaggtccgtatggaacggaaaaaaataactgtgccgggaaaaacgatggagaggaatcttcataacctgaaaccggtaaaagagttcaaatatacggaaaacggggatgtggagacggaaattgaaatagcggctattggggagattgcttttttaggtgtgaaaccggagcttaactgtattacagccgccgcagtcaaagcgttttctccgtatgaacacacaatcataactaccatggttaatggtgcttccaaatatatggcggataaacgttcctatgatcgatttacatacgaggcacaaaattctccctttgccaaaggggcggcggaaatattaatgaaggaaagtatatcgctgctgaatgaaatgcatgaaaaccgtttgtaaagagcagaaagggcagactgaaatgaagaattctacaattataacggagatagacgggcaggggcagaaaatcgctgcagtcgtattggaattcggcgaaagtattaagcctgtggatatgcagccggataattatgcagtggagaaccagacggttaaagaacttctggtatgttccgttccggagtgggaaaagctgttccggcagcagcttccggcggaaaaatgggcagaagagctgtataagagcacaccggagcgtcagccggccggaaactgtgttatcttaattctggacaaaaacagaccggaagcatcactcaaaagaatgacgggccggggaccgggagccaggctggtgattgctttaccggaacttgaaatccgcctgaaagcagaacagataaccgttacggtaacagctgtaaaggatgctgtggcggataactttgataaaggacaattttgctgcaacgacggatattcgatttcctataatctgtttattccggaaggatatgatccggaacgaacctatccgctggtactttttatgcatgatgccggctcctgctcagatgatgtttcagccgcagtggtgcagggaaacggtgcggctgtatgggctttaaggaaggaacaggaaaaaaggccatgttttgtattggcgcctcactatccggaaaagtgtgcggaggatgattttacagttggacgggaagcggatgcaacggtggaattggtgaaggagctgatgaaaagatattccattgacaagaaccggatttatggaacaggtcagtccatgggatgcatgatgctgtgcgaattgaatatacggtatcccggctttttcggcggatgctttctggtggccggacaatggaatccggaaacaatgcctgcggcaagacatggaaacttatggattctggtatctgaaatggatgaaaaggcatttcccatcatgggagcctgtgtcgggagcatgaaagcggtcggagctgaaatcagctgcggttcatgggatgcacacagtccggaaaacatacagaatgaagcggcagaaaaagttgcgtctaaaggcgccggaatcaattttacatggtttgagggagacagtgttttggaatcggatgacagacgttttccgggagcctgtcatgtcaaaacatgggaaaaagcttatcaggtggaagccataagggaatggctgttcaggcagcacagagaaatcgatttttcaagtaaacataatattttgatcaggaacacggacggcacctgtttacctatggataagccttattatgatgcaagggaagtggttccgggtgtctggcagattatgagcagcggtgatttttcttattgtatcgcaggaagaaaaagagctgttgccatagataccggttacggtgcgggaaatatccgtgtttacctggaacagctctgcggacttccggtgcgctcagtaataaatacccacagccattttgatcatacggctgacaacgcttatttcgatcaggcttatatggcttacaaggctgttttgctggcaacgattcccttcgcaagctttgcagggattgatttctgggagaaagattatgagcggatcggagttggagaaggatttatctgtgatcttggagataagactctggaaatttttgatatccccgatcatacggaggatggcattgcaatattggacagggcggacagaatcctttttacgggggatgaatttatggccttcggtaaaatcctgagccatgccagtctgacggaattctatggctatactcagaaactgctggggcacaggagtgagtttgatataatctgcgccggaggaggcgtatttcctgtttctttacttgaaaattatgataaatgtgcggaatatattttaagcggacatcagggtgaagtctttgatgggaatgccccgcggccgggaaaacttccgtcgggaccaaacggagagatcgtatatgacaggatgatgccgcatttcggagacggcggagcggggaaaatgggaataacggaaaggaaaatgtacagcatggaatatgcaggtgctaagatagtatatgaataaagaaaaaaatgaaaggatgacggagaaaaccggaattcagaatctggatataagaattgccattgccgtagctatttgttttttatctgcaaccgcatgcagtgaattgggtttcaaatttacatatggagaaatgcatttggaaatattacagaagatgaccgcatgcatagcctgtctgctctgcgttcaggataatacgaaaataagcaggaaggccggtgtgaaccgtatgattattacagcaatcggaggcattatcggtattggcgctgctgcagctgataatgcagtcggaaatccatggtttatgacggtgcttatattcgttggtattttacttacgctgctgctgtgtaagatggcaaaggtaccatatattaatgcaagaatcggaggagtgacattcatactggtttcttgtaccttcgcaggaaatgccagaattttttacgcggtgttccgttttatatccacattctacggagttttggtagtattgcttgtttcctggttttttcagaaatttattctggatgccagcggagaacattgtaaattactgaaaaatacggggaaacatgcggcgtgaagaagagtaaaaatcaataattatatataggtaacaattcgatatacaggattcagaataaagtccctggaaattatttttccagggctttattttaaaatgactgtaacaaaagtttatttgaaggtcaggtaattcaaaactgtttttccattttcatccggcctcctgcaaaactcatgataaattttcctgaaattcaaccgataatataagtagccaattaatggaagcatacttcacatcatacggaaaccaacagttccgcataagaataaaaacagcatcacccgcataaaatacgcattttacttgtaaatacaggcagattctgttataaagaaaacagcatttccggggcatgctccgggattttgactttttttcacaaagaaatcatatcgttaatagaaaatcaggcaggtatatgataaaataaaaagataaatgctgttttaaatcatcatcagcttcagtaaaggcaggacagggttatgccggaaaagttctgcgcagacagtgtataagagaaaagagaggtcagtattcataatgacagtgaaagaatgttatgaatgtcttggggcggactatgaggatgtaagctgccgtttgaggtcagaggaaagaatcttgaaatttttaaaaatggtattgaaggataccagctttaaggatttgtgtgacgccatggaagagcaggactacgaaaaagcctttcgtgccgttcatacactgaagggggtattgctgaacctgggattgaccgtacagggaagatatgcggcggctcttacggaagcgctgcgcggcagacaggaaaatgaggaaataaagccattgtttacgcagctggtttccagctacggagaaatgtgtagtgctataaaggaactcgcagagacttcagagacgggaggcatccagaatggataagagcaacaaaattctgattgtagatgattcggaaatcaaccgttctttactggcggatatgctttccgcggattacagtctgctggaggcttccaacggccttgaggcaatggtgctgattaaccagtaccattctgaattgtccatggtgctgctggatatcgtcatgccggaaatggacggatttgaggtgcttgcttccatgaacggtgcaggactgctggaacgtcttcctgtcatcatgatttctgcagaaacctcttccgcatatattgatcatgcctatgagctcggagcggcggaatatatcagccgtccgtttgatgagcagacggtaaagcgccgtgttaaaaataccattactctttattccaagcagaagactctggaaaacctggtgacggagcaaatcctggaaaaagaaaaaagcaacctggtcatgatagaaatcctcagtcatatcgtggaattccgtaacggtgagagcggccttcacgtcctgcatatacggattatcaccgaggcgctgctgaagcagctggcaaagcggaccaaccggtataatctgaatgcgaaacaaatcaatctgatttccaatgtgtccgcgcttcatgatatagggaagatttccataccggaggagattttaaacaagccgggcagactgacgccggaggaatacgaaattatcaaaacccacagcgttatcggggccgagatgctggaaaacgtgccttattaccaggatgaggaactggtgcgtatggcaagggatatctgccgctggcatcatgagagatatgacgggagcgggtatccggatggcttaaagggggatgatatccccatatcagcgcaggtggtggctctggcagatgtttatgacgccctgaccagccgaagggtttataagcctgcctattcccatgaagaggccctgcgtatgatcatggatggtgagtgcggggcattcagtcctttattgctggagtgtttatgcagtgtgaagccatatctggaaagggagctgcatgtgcgttccgcaggggggatatccaagatggaactgcaggatatgacccgcagcctgattcagagcagcaacgcttctaaccgtactctggcattgctggagcaggaaaggacgaaataccagttttttgcttcgatgtccaaggagatccagtttgagtattcaggaagctccgacgtgctgaccgtttccgactggggcgccgagcagctgggagtgagttccgtccttgtacatccgggcagaaacaaggaaatttacaaaatatttaccagagaggattttgttgatctgaggaaccgtctaagcagcgccaaaccggaggagcctattgttacctgtacctaccgcatcaatgtacagggcagcccgaggtggtgcaaggttatagccaggccgctttgggtgatggaagaaacaaacgagctgactgggatgatcggtaaattaatcgatatccatgaggaacatatagaactggaccggctgaaacagatagcccgttatgattccctgacagggctttataaccgtgcttatgcctgcaaggccatagaagaggcactgaaggaaagcagggcggaaaataaaaaattcgcattgctgcttttggatttggattattttaaaaatgcgaatgaccagtacgggcatcagttcggtgatcgggtgctggaggaagtggcgataaaggtgcgcaacagcgtgcgtgcaaatgatatctgtgcccgcatcggaggcgatgaattcctgatttttatggaatacaaggataacatagagcttctggtagacagggtttatcaggctattggcggccggtatgagaattttgttatcgctgcaagcatgggggtggcacttgcgccggagaacggaatggggtatgacctgcttttcctccatgcggataaagctttatatgccgctaagaaaaatggaagaagtcattattgcttttatgatgattccatgcaggatcttctttctgtgctgtcacgggttgatgacgtggacagcggagccggcagaagataaaaacagtattgacaacccgtacctgtattgctatactgttaccaataaataaaaggaggctgatattatatgagaaaaactttatcacatgggaatttcataaacattaagtcagcctgctatgtgagataagtaagagcgttttatcgtgaactttttaaccacagtttcagactgtggtttttttgtacgctttttaccgcaggcaggcattccgttcccataaaaggaatgtaaaactgactggaaagcgtataatatatggaaaacagaatattgaatctgggcattatggcccatgtggatgcaggaaaaaccactttgacggagagccttctttattacagcggaattgtaaaaataaggggaagcgtggataaaggtaccaccatcacggattccctggaattggagcagaagaggggaatgacgataaaggcttccacggtatcctttcctgtcggggatgtgaaaataaatctgatagatactccggggcatgtggattttatcggagaggtagaacgctgcctgcgggcattggatggggtgattcttgtaatatcggcaagagagggcgtgcagccgcagacccgtatccttttccgccagctgaaaaaaatgcggatgccggtcctgtttttcatcaacaaaattgaccggccgggcgccgattatgaagcggtttgcgttcagatccgctcccagcttacgaaaaggcttcttttcatgcaggaggtggtaaaaactcctgagcaggattatcggatcagggattacggttttgatgacagtgcatacaccgatcagatccttctcagttcggaaaagctgctgaataaatatctggaaggggaaatgaccggtgaagaggagctgacggcggctgcccggttccgggcgggtaagggaaggctatatccggtctatgttggttcggcgctgaaatgtctggggatagagccgctgatgcagggaattatacggtggctgccggtgagaaggcccggtacagacaggctttccgcctatgtttacaaggttgagcatgatgagaaggagcataagcttgtttatttcagggtgttttcgggaagtatcagacaaaaggataaagtactgattgcgggtacagagcaagaaattacgattaataatcttcggaccgtgaaccggggaaagcagataccggctcaggaagtaagcgcaaacgatatagggattctgacggatgttccggcattaaaatgcggcgattttctcggcagcatgacgcccggtaaggggacaggacttctgatggagccgatgctgtgtgtgaatatacagccggcagaggaagaggacaggtacaggcttctggatgccctgaatgtattggcggaagaggatccccttcttcatatacgaattccggaaagaaccggtgaaattctggcagacctttacggaaaactgcagatagagattttgaaggagcttctttgggaacgatttggtctcagaacggtattttccggaatgaagacgatcggcagggagaaaccggcaggcccggtgtatgccgaaatacgtctgggtgaaaaaggaaatcttcaccgggcaggaatcggaatccggatagaaccgctggaaacgggggctgggaaccggtatgagacacaggtctcctttggttatattgaaaaatcctttcagaatgcggtgcaggaaggtgtcatgaaggctttggaggaaggaatttccaacgaagttacggatacactggcagtttttgcagatgctgattatgacagtgtgacaagcacgccggccgatttccgccggctggcgcccaaggtggttcaaaaagcgctccggcagacaggggtcataaccctggagccatacatggactatcgtctcattgctccggcaggagatgaaaaaagaattatggcaaagcttgcaaagctgcaggcgtcggttgaaaatgtcatctatagtgacggagaaatggaggttttgggagaagttccctttgatacggctaaggagtttcaggtggatttaagaagtatgacggacggcaaaggaatttttgaaatggaatttctggaatacagaaggaacaggcaggaatgaaaaatttttaggaaaagatattaatttctcagataattttctttttcccatatcttttatagaataaaaatgataaaataaatggaatgtatcttgaatcggagctaaaagggaagcggcggctctctgaatgaaagtaccgcagaaggtcccgtcgatcagggaatgcggataaagttagggcagagattatggcagaaaacaggaagcaaattacagaagactttacttcacgtattctggaagtgcgatatacagatttggaaaaggaaaaaaggctgtgcctggaattgcttgtattggcaaaggaagaatgcgatctctatggggaagtatttgccctgacctatatgggggattattacattgcggtctccgatatggacagggcgggaaaatatctcctgaaagcccagaggatgtttccggaggatcaggactgggaggagcttcgtctggggcttaccagtctcctcggaatctattacgacatgtgcggggatgagcagaatgcaattgattattatttgaaggcggttacgattgcggaagagctcggagatgcggacagggaatgtgtggttttaaataatctcgctttcgcttttcagcggcaccggtgctacgaggtggcgctggaattttatcagaaggcttactggctgcagaaaaatgccggaatcaacccggttcgttccatattgttggaaaacctggctgaggtttctttgtttctgcggcagtacgaggaagcaaaggaatatattctggaatttgaggaaaacgaaaaggatcctctccagagggtggtaatgggagataagaactggtgctgctactacggtgctgtcggtgagcgtgaaaaagcgctggtctatgcggatcgcctgctcaggaatcaggatgtcattaatgaaaataaaatgacagcctttgaatcttatcacatgctgtgtcggagcatgatggaattgagagaagccgattatgccggccgctttctggaggcgatggaggaagtcagcgtcggaggaggactggatcaggtacagactctggaagagatgcggatacaatattctcttttatttgagccgccggaaaagcatccggaggcatattgtgttttttacaaaaaaaatcagcagttcagggccaagatcgacgaaacgatagcaggggcgatgaagaccaggattcagctggaacagctgatgcagcaggttgaggatatgcagtccgagcaggagatactggaacgtgaagtgaaccgggatgaactgacaggagcctataacagaagatttctggagacgctgatacgggagcataccgatggggcggcggaagaaagctttgcgtttattgtcatggatgtggactgctttaaggaatacaacgatttctacggacatctgaagggggatgaggccctgagggagattgcggcctgtatgatggaaggcgcccgggagcggatatatgcgtcccgttacggcggggacgaatttgtatgtgtctgtatcggccttacggaaaaagagatccgcacctatattgaaggagtgagagcccggctgcatgcaagggcaatccctcatgaaaaatccctgtgcagcggcgaagtgaccctttctgccggctatgccgcagggatcgtaaaaacgcagattgaggtgcggcagctgcttcagcttgccgaccatgagctttataaaagcaagaattccgggcgcaatacgtttacagggaaaagggtggatatattatgatggaaaatgacaaaaataataagtcttccctgccggaggcccggttaatgcagcagattttaaaagcccgccatacagatttggaagaagaaaaaaggctttgcaaagagctgctctctgtttcggaagcggagcagtactattacggcagcgccttcgccaatgtatacctgatggacagtcagctgtccatgggagaatataccagctgtgacttttatctgctgcgggccgttttcctgtgcagggagtatggctatgatgatttgatgctggtgctgtgcaataatgccggtctttattaccagaagcttaacgatgatcagacggctctttcctatttgctggaagggaaaaagctggctgagaagctgggtgacatcacgatgcttggcaaactgtataataatatcggctattccttcggcggcagggatgactgggagagtgcgggagtatatttccggctggcataccggacggtggaagaccatttggatgaagaaaacagaaggagctccatcagctatcttagtaatatagctgaggcatgcagaaatctgggagatctggagggcgcaagaaaagccatggagctctgtgaggagctgggtgcggacagcgcttacagccgcgtcaggttaggcgtcagctggtgttcctattatgccatgtgcgaagattgggataagtttaccgaaatggccgacaggctcataaattcggatctgttggctgtggaggatcacttttttatctgtgacatggcggaaagcctgtgcacggaaatgctggcagcgtgtgatgaaaagcgcgcggaccggctgctggccatcatggataacctggaatatgataattcgctgtccctgaagtatcggattcaatgcctgaaaatccgttgctgggagcagttcggggaaacagataagctggatcaggcctaccgggattattatgaaatcgtaaaggatgtttctgctgtggaagacgatatgcgtatccagagcatgctttccaaaatccagattaaccaggccatgcatgagcatgaggaaatggtccggaacaagcgcgcccttgaaaacgccagccagctggatgaactcaccggcctgtataacagacggtatttcaataaactcctcagcaagatgactcataaagaggatgggaaaaagctgggcttcattatgttggatgtggattatttcaagccatataacgacttctatgggcattttaaaggggatgatgctttaaagtcagtggcccgtgttttgaaggataaccagatggacggcatgtatgtgagcagatacggcggagatgaattcgtatgtctgtgtatggatttggaggatcgggatatcgaggagtatataaagcgggtcggcagggatatggaagccgtggcaattccccatgaaaagagtccgggggcaaatgtgcttaccgtttccatgggatactgcaatgagatatacaggaagggaatggattgggagccggtgcttaaccgggcggatcgggaactgtattcgataaagaagaagaaaagagcccgtattaaaaattgattgacaaacctcttgattcgccgtatcatataacagtgttatatgcggaggtaggttaatgaatgaaacggaacagacaacattaaacctgattctttcggccgccatgcaggaatttcttgaaaaaggtttcaaatccgcttctctgcgtaatattgtcaaaacggcaggagtcacaaccggtgcgttttatgggtactataacagcaaagaggatttatttgaagcactgataggcgaacagtatgacttccttttagactgcttttgcagggcgcagaaagaatttgctgacatcccgccggaagaacagccagataatcttaccgacatatccggcgagtgtatgtatgaaatgcttttgtatgcctatgaacatttgaaggagtttaagctcattctctgccgatcagaggggacacgtttttccaaactgattgatgaaatggtagagatagaaacaaaaggaactcatgattatttagcggtgcttgaaaagttaggcagaccgtcgccgccgattgatgaacggttagagcatatattgattaccggaatgtttaatacattttttgagctgattatacatgaaatgccgcttgaagaagcaaagcattatctgaaggaaatgagagctttttacaccgccgggtggatgaaaattatggggcaataagccctgtaatttttatacatgagttagttaaaactaacatatttcgtggatattcgggaacgcatcttgcgttttcctatcataaataattttaaggaggttttacaatgaaaaagcaatcgaatctatcgagattgatggggtatgccgggaaacataaaatattaacctatctttcttggatactgtctgcaacgagtgcgctgttggctcttgtgcctttttggtatatatggcgtatcattcatgacatactggaggtttcccctgacttttcacaggcggggaatgtgacacactatggctggtctgctgtgttgtttgcggttatatctgttgtcgtttatatagccgccctcatgtgctcgcacataagtgccttccgggtggccgcgaatatccgaaaagaacttatgcggcatattgcggccctgccgcttggagtaacagaaaaatatggaagcggaaagctgcgcagaacggtaaacgatgccagtgccgctacggaaacttatcttgcacacagactgcccgataaagcaggcgcgattgcaacacccataggactgcttttccttctgcttgtgtttgactggcgattaggacttttaagcctggttcctgttgtgctgggctttctgattatgatgaaaatgaccggaaaagacatggagcagagaatgaaggaatatcaaaatgcgctttccgatatgtcaaatgaagcggtcgaatatgtaaggggtatacccgtagttaaaacttttggacagacaatattttctttcaaacgcttcaaagcgacgattgataattacgaaaaatgggtaatcgcatacacaaaagcattacgtctccctatgatgttttatacaaccgcaatcaatggtgtatttgcctttttaatcgcaggaggtattctctttacgaggagcggcgtaacaaatgagctgctgctgaatcttattttctacatagtaattacgcctgttatcggtacgaccttgaccaaaataatgtttatgagtgaggacgcaatgattgtaagtgacgcaatgggcaggattgatgaagtgctggacgaaaagccgctgtctgaaagcccggtgaacaatataccgtctgataattcaattgtattagaacacgttacttacagctatgacggggagaaaaatgcactcaatgatgtatctttgcggataaagccgggacagacaatcgcattagtcggcgcgtccggcggcggtaagactacccttgcaaatatcgtaacaagattttttgatccggatgagggacgtatactgataggaaataccgacatacgtgaaattccgaaagaaacattgatgaataaagtgtcttttgtatttcagaacagccgccttattaaagcgtccatcttggaaaatgtgcgtatggcaaagccgggagcgacgcgcgaagaaatcatccgggccttgaaagctgcacagtgcatggatattattgaaaagttaccgaacggcattgataccgttgttggaacaaacggcgtatacctgtccggcggcgaacagcagcgaatagcaattgcccgtgctgttttgaaaaatgcgcctatcctcattcttgatgaggcgacggcatttgccgaccccgacaatgaggtgctgatccaacaggcattatctgctctttcaaaaggagaattaaatagcaattcccctggaaaaaccgtgattatgattgcacacaggctgtcgtcaatcacagatgccgactgcatttatgtactgaaagacggtaaaattgccgaaagcggcacacacagcaaactgatagagagaaacggcatattcacgcgtatgtggaagaattattccgaagcggcagaatggagaattgcaaaggaggcaaaagcatgattaagacattgcaaagacgctttgcgttatcaaaagagggggccgtcgatttaataaaagggtgtattgcctgcgttgcacaggatatatcttttatgtttcctgtcggacttctgtattactttgtcattgatactatgaatggcggtgtgagtgaaaaccgcatagttttttatgtagttggcgctttggtttgcttatgccttatctttatcgcgacttggtttcaatataacactacttatttagcaacctatgtggaaagtggggtaaggcgtatttccttagccgagcagctccgaaaaatcccgttatccttttttggcaaaaaagaccttgccgatttgacaaattctattatgggagactgtgcaacacttgaaacagcattttcccattatgtccccgccctggcaggctccatgatttcaacaacgctgatcgcgatctgtctttttgtttacgattggcgtatggctcttgcggcggtttgggttttgccgattgcatttgcaatcacattcttttcggcccgcatacaagggtattttaaccgtaaatccgtagcggcaaaggtcgctcttgaaagcggtgtgcaggagtgcattgagagtttgcaggacttaaaagcgaataatgcggaaaaaacttatctgaaaggacttgaccgaaaaattgatcaagtggaaaaacggcatattatttcggaacttggaaccgctctttttgttgtttcatcaacgctgatattaaagtttgggattgccacggttgcgcttgtaggttccgctctgctcattcgcggggagattgatattccgctgttttttatgtttttacttgtcgcttcaagactgtatgctccgctggagggcgcactgcaaaatcttgcggcggtgatttctaccaaaacaaacataaaccgtatgaacgaaatccttgatcacccgatccagacaggaagtaattgtgtgacgaataaaggttatgatattgtgttcgaccatgtaggctttgcttacaataccggagaaactgtattgaaaaatgtgtcttttactgctaagcagggggaagtcaccgctctggtcggttcgtccggcggcggcaaaactacggtgtcgcgtcttgccgcaagattttgggatatcactaaaggcaaaatcactgtcgggggcatggacatatcgaagatagaaccggaaacattattgtcgctgtactccattgtttttcaggatgtgacgctgtttaacaatacaatcatggagaatatcagaataggcagaaaagacgcgacagatgaagaagtgatcgcggcggcaaagttggcaaattgtgaagagtttgccgagaagcttccgaacggatataacagtatgattggtgaaaatggctgtgaattgtccggcggcgaaaggcagcgtatttcaatcgcccgcgcttttctcaaaaattcccctatcattttactcgatgaagcaacagcaagccttgatgtggaaaatgaaacactgatacaggcggctttgtcaaggctgataaagaataagaccgtgcttgttatagcccaccgtatgcgtacggtcagcggcgcggatcaggtcgttgtgctttcggacggctgcgttgcggagcaaggtgcgccgggaaaactgatggatacaggtaagatttatccgcatatggtaaagctgcagatgattagccggaactgggggatttagtatggatacccccctgctggtaattaccgctgtccttcagcggtattaccggctgttttgatatactccaccaatttatccatcggcagcggcctgctgtaatagtacccctggtaaaaaccgcagcccagctccgccagaatgtcacgctgttccttcgtttccacatattcggctaaaatacgtaaatcaaggctgcgggccatccggataatcccggatataatgtccctggaacgtccgttgccgggcagctgggttaccagatggccgtccagcttgacttcatcgaagatgccttcctgcaggtacaggatagaattatgtcccatgccgaaatcatccagactgaaggaaatgccgttgttctgcagcttcttaatatcatccatcagcgaatccgtaattttcatggccgaccgttccgtaagttccaaggcaaaatgaattcttgacagctgaggcttctttaaaaccatgagggtgttatcaaaaaatccattttcctcaatctgctttgccgatatattgatggacaggatcaggtcgttttccagctggggatccagtattcttgcatcattacaggctcggttcagcagataactgttcagctcattcagaaaaccgccttcataggccagggcaaagataaccggaggagagatataaccggtgaccggatgctgccagcgaagcagtgcctcgattccatgtatatttccttccctggatatctggggctggtagaagaaatccacctggccgcgatggagcgcatttttcagatccagggacagtgttttggcataataattatagggatatttatggctcagaaataacggcagattgccgctgctttcccctgcttccatatcctgttccatctgccggacgatctgctggaattcagccgtttccttttgctcactccgtctgataaaggggatataaatacagattcccaccatgaggttaatgagctgaaggatacttcctgaaatggaaccggttgccttgtagccgctgaaaagaatgggtacggtccagtccacggattgagtgacaacaggcacaagccctgatgccgtcgcaatatagctgataagagtgagtacgacaggcgtaaggatgaaaggaatcgccattgtaaagttataaataatggggaacccgaacacggctatttcactgatattaaaaaaagcggagggcagcgccacatatgctattttccggttatggcttctcctggacgcaatacacagggcgataataaagcttaaagcgcagccgcagccgcccagaaaggcaaaggtatccaggaatgtcttggaaaagatttctgtgggcacctggccggccagtaaaagagactggtttacggaaacattcggttcaaataatcttctggacacagcctccagcgtattggtgccatggactccgaaaaaccagagtacatgggtgataatcacataaagcaggattccgaacagattgtcgcttaatttgtcaaatattttcagaaatatataggccccgaaattagttatgttattgcttccccaggcggtccggagaagatagcccaggatcgcaaaaaaagcgataatgataattacgggaaacagactctggatggagatgttgaataaatattccgcacctgtggtatggagcttttccatgcggtcgctcagcttcagtatcctgcggaagagaatacaggacgccagtgtgatgaacatggctgtaaaaacccattccgcattaaatacatattcctcatgatcctgtatgcctccgcagaaagccatataagagcatagggcaacaaccggatacagaatgtacatgtctatttccgccagaagcccataggaaaggctgattgtaatacagaggacgagggccagggaaccgaggctgatgttatataaggtcgttaacagagcgacagccgaaccattcagaaaattgtgaagaaaggtttggtagctgtcacttggaaaattcaaaaagagcagggaaaaagatcccagagtgagaaagggaatagccagcgtgagtccccgacgtatggattgagctgtaattgagtttcgaaaacgggaaataatcggcttggattccatgcatactcctttcgccattttgtagaataaagatcgtttctacataagcgttaccataatagtgtataataaacctacatataaaacaatagtaaaaaagcagtagttgtgtgggcgtgggagaggattcgtatatctatacctataatatgaaatcctcggcagaatgtggaaaatattaccagatatgtagtgagaatagtcgttatagaaaagtggcagaaaaaaacatagctgtatcagagccgcgctgtatccgcggccctgtatttttatcaggtatttgctgtttcgcttccggggtattccagaatgaggtgcccgtttttcccgttgttttttacccggtacatggcggaatccgcaaggccgatcgccttttctgcgctcagggtttctccttccacgacagcaaaatcaatccttacggcgccgatgcagcagtaaatgggcaggcagcagtcactgcctcttattacaaaactgcttcccgctttttcctcaatctgtctcaggcactggtcaagggaacggacgttgtccggtttttctatgattacaaggaattcatcgccgccgacccggccgacggtgccttcggattccctggtcagcagggaggtcaggaacagcagcacctgatctcctacatggtgtccgtacttgtcattaaatattttgaaatcgtcgatatccaggaaaagaacagccatttccgtattttctgagcaatgcctgtccagcgcctcctgaagatactggcttatgcgttccttgttgagaaccttggtgagagcatcctgttcggccttttgctgcagcaggcgccgctgctgggctttgtaaagattttccgtctctatatagtcaatcaggttgttgacttccaacgccagcctgccgatctcatccttacgttccacggaaacccggagggaataatcctgggattcccggatgtccgtcagcgtggaggatatgctttttatcggatggacaatgcgcttggaaacaaaggagccgatccggaatgccagaatggtacacagggatatcatgaaaaaagccagaatatagtatacatatttttgggacaggtaattatccatgctgacagtcagcaaaaccagccaatgtgtgtactttacattggagtaataggtgatgtagtcctttccgcctaccttatattgaaaatatccctgaggatttttaacaaaatcaatgctcttgtaattttttatatagtccttgcgttcggcagccgatgtgacaaaattatccctgccttcctcagacgttccggcgcttatgatctgctgacggccatccagaaggtagaaggtggcatcattccagagctcagcccgttcccggatgccttcgtagaaatccagattgatttccatgagggaataaccgagagtctccccgtgttcatcaattcttgcaatagccacaagggttttgttgccctgaccgtcaatcaggatatctgaaaaaaagaaatcctgatctctcatgcttttaatcagggaatcaataccatcattagcgaaggtactgtgttcttcactgcatgcaacaacacggtaatcagagtcaatcagggcaaaggtattcagatagctcaggctttccacccgggaataaagcatattatcaagatacatgcacagatctttatccaggctgcccttcatggcggccctggagatatccatggtaccgatcatggtcatataatccttctgctgctcacaaaaatccgtcatttccgtaacatgggttgttgcaacaacatgaaggctttcgatcagggcattctgcagcccggaggaataaatataggtggttatcaggctgaaaagcaaaaagggaagagcgatcatgagaaagacgatccggtacatggaagttcgaatattcataaggggcacctcgccgcgtgatataaaatcggtaccggacggctgctggacggccctgcaggaaggcggtgaagatccgggggtactgtttctattataaccccccggataaaaccgtcaatatgaaatgttctgatctctgacttctgatttgggaactgatttgggacagccgcagggaaggaattgccgctgcctttgatttatgtcatattctgcttccttttcaacagtgcgctcatggaacgccccatttttacaggaaaaagatagcacaaagctgtctgaagctgctggcctacagaatggcagatataaaagctctctttatttattctgcctgccaggccatatcccacagctttcggatccgccatgaaatcccggggtaccggcagcggagcggcggacctggttctggtgagcgggggatgaatgagctggaaccggatccccttttccatatattcaagattcagacatttggcaagggactcgatagccccctttgacgatgcataggggctgatatcaggaaatcccataatacctacgccggagctggtaaaaattacttttccctttcctgctttttccatgtaaggaacgacggcctttgcaagtctcagagctccgaagtaattgacatggaaaacttcttcatatacggaacattcggtatctttcatgggaccgaaagtacaaaggcaggcattatgtatggcgatgtcaatgtcaccatagttggttacgctcatccggacggcttcctgtattccgtccttatttctgatgtcgcagataacaggcagaagctgcgcagggtatttttctttcagcttcagaagctccgttatttccacatcaagcacagtaacatgatttccaagctccagcaggtgctcagtcagataaaatccaattccctggttcccgcctgtaattataatatgcatattagttttccttccgataggtttgtaaaaagctgcctgccgcagacatgacagcctgtttgaagtgttccgtatccttttccgtatagtcgtggttcatatactgattgaaaaataaataaacaggggaatagtattcgagagccagatgccggggattctcttttttaagataaccgatatcctgcagctttttcatgacagttgtctgaaagtcaagcggcttttctatgcaccagtttatatactgttcccgaagctgatcgttatggctgcgttcatgattcattatcataaggatccggctgatgaaggtatccataaaataagattggatatattgttccgttacggcataaaaatgttcgtcatccattgccgtaatgctgcttattccttcatccagcccttccatcatctgccgggagatatggataaacctgtccataagtgagtcaagaatggcctgcttgcttttgaaatgaaaataaagggagctgtctttaattcctatttgtgccgcaatatcccttacggatgaggaatcaaatccctttcgggaaaataaatccagggcggcttcctgtatcagttctttggtttccatgataataggactcctttctgcgcctagcactcgctagattcattatatcaagcgagtgctaggcagtcaagtaaataaaataaccacccgcacccgataggaaggtatgatctgcgtatcagagtatactcagtcaaaataaaataagtcttcgaattttttatccagcgcgatgcagagtatcagcgccagcttggctgtagggctgaactgacctgtttcgatggagcttatggtattgcgggagacacccaccagctcagcaagctgtgactgtgacagcatccgttcatttcgtgcttccttcagccggtttttcaggattaattcatcattcatattccacctctcaccgcaccgcctgcgaagtcactaaattataaatatgggaagcagagagaaggagaacaaaaataatataaatgaccgctataaatatttcatgcttttttttcatgcggaaggccttgacggtgaaggctgcggcggggatggaaaagactacggcatacagtccgtaattaatccccccgccggttaaaatctgtatgacaaaaaatacggtggccagaaatccagctgtggcggctccgatatttctgccctccttcagaatttctttttcataaatatcctgattcttattttccttacggcttttttccaatatttgatctttttccataacaggtatcctttcctgatgccaagttttcttgtcaagaacagaatagcactgccaagttaacttgtcaatatgtttcgccaagttttctttgcaccggctggttttatgcagcagcatgtgagaacagggcatttttcatatgttacagacaaatttgaaattattttacaaacttttgtttataataagcaagaaaaaaataaaattacatgatataatatatgatataaatgaaacggaaagggttacttgtttgaaaacactgtcaatatgactaaaacaaaggagatgaaccatggcagaaggaagagaattgatactgaagctcggtcagaagataacggacaggatcggagtgaaggtaaccacatcggatccggaatactgggggctggcatgcgtgataacggatgagatggcggaggtcgcgctggctatgaaggtgagggtcccggccacggcccagtggattgcgaagcggtgcaaaaagagcgtggagcgcacggaagagcttcttcaggagatgagcgttattggcctgatcgaatacaactgggagaatgaagatcatcataagcagtatgtgcttcccatgtttgtgcccggctgtgcggaatttatgatgatgaatgcaaagcaggtggaggagcatccggagctggcggatttctttgaacagatggccaggctgcctctggaaaaggtgacgcctatggtgccttacggcggagcgggtatcggcatgcatgtcatccctgtggaaaaagccattcctgccaggcaggagtctgccgatatcgaacatatttcccactggctgaacaaatacaaggacaaatatgcggtaggcgcctgttcctgccgccgccagcagcgtgtgaggggagagggaaccggcgatctggaggatgacctgtgcatcggcgttggcgatatggctgattatctcgtggagacagggaaaggccgctatatcgattatgatgaagtcatggagattctgcagcgggcggaggataacggttatgtccatcagatcaccaatatcgacggagaggaaaagatttttgccatctgtaactgcgccatcggcgtctgcaacggactgcgtacctcccagctgtttaatacccccaatatgtcccgctcggcctatcgtgccagtgtgacgaaggaggactgtgtggcctgcggccgttgcgtggaatattgtcccacaggcgcggcgaagctgggacagaagctgtgtacaaaggacggggaaatcgaatatcccaggcaggagcttcccgatgaaacaaagtggggcagggataaatggaacgtggactacagggacaggaaccagattaattgctatgataccggtacctctccctgcaaagcggcctgtccggcccatcttccggtacagggatatatcaaaatggcctcacagggcaaatacatggatgcgctgaagctgattaagacggaaaatccgttcccggctgtctgcggcgccatctgcaaccggcgctgcgaggatgtctgtacaagaggaacggttgatcaggcggtggcgatcgatgagattaagaagtttattgccgaacaggagcttcatgcggaaaacagatatattccgcagatgctgaattattccggcaagccctttcaggaaaaaatagccgtgataggagccgggcctgcgggaatgtcggccgcattctatctgaaaaaacagggctatccggtcactgtttttgaaaaggaaaagaggcccggaggcatgctgatgaacgggatcccttccttccgactggaaaaggatgtgattgaagcggagatcgatgttctgcgggctatgggcgtggaatttaagtgcggagtggaagtgggacgtgatattaccataaagaagctgcgggaggaaggctataaagccttttatgttgccatcggagcacaggccggacgtaaggccggggttccgggagaagaggcggaaggggtactgacggggctggaattcctgcgttctgtgaaccagaatgcgcaggaggtcaggctttccggatgcaccgtcgtcatcggcggcggaaacgtggcggtggatgtggcgaggacagcgctgcgggcgggatcggataccgtttccatgtattgcctcgagtcaagggaaatcatgccggcggctgccgatgagatcgcggaagcggaggaagaaggaatcaccatatgcaattcctgggggccgaaggaagtcctcacggaaaacggcagggtatcgggagtggtgttcaaaaaatgtatttccgtatttgatgaaacgggccgttttaatcccagctatgatgaagaacagctgctcacggtggaatgcgaaactgtcctggtgtccatagggcagtccgtccaatggggagagctgctggcgggaacgaaggcggaactgaacaggaacggtacggtaaaggccgatccgcttaccctgcagaccggggagccggatatcttcgtgggaggcgatgtatatacgggaccgaagttcgccattgacgccattgcggcaggaaaagagggaagcgtgtccatacacaggtttgtccatgaaggacagagcctgaccataggaagaaaccgcagacagtttatagagcttgacaaagagaacctgaagctggaaccggaatccttcgacaatgcaaagcgtcagataccggggcggaaaagcccggcccaaaaagcggacttccgtgatctgcgcagcacatttaccgaggaacaggtgaagacggaggcaaaccgctgcctgggctgcggggcgaccatagtggatccgaataaatgtatcggctgcggcatctgtaccacaaaatgtgaatttgacgcgatccatctcagcagggatctgccggaagcgagcaatatgtataaggcagaggataagatgaaggccatacttccttatatgctgaagcgggaaataaagattaagttcaaagggaagaagggacgtgagggccagaatgcatgaattggggatcattgtacatatctcccggactcttgaggaggtggcaaaggaaaaccagcttacggaaatcggctccgtgactcttgaaatcggagaggtcagcggagtggttcccgagtatatgacagactgctggaagtattaccgcaggaaatcagagcttttggaagaatcggagttgaaaattgaaatccgtcccgcggtaaccttttgcgaagcctgccggaaaacttatcccacggttcggtatggcagacaatgccccggctgcggcagctgggaaacgagcctgttaacgggaaatgagtgcagcattaaggaaatcgaagcctgctgataaaagccggcttacaaagtataaggaggggagcttatgttatttcatgtttacggcagcaatgccgcttctcagtggattgccatgattgctgttttagtggcgcttatcctgctgaacgaattttcaagaaggagcaaattcggagggcttttcatgttcggagtcctgccggcggcgcttactgtctattttgtcgtgattgccgtgtctgccggacagggagcagagtgggcgcttcagaaccagacctacctgtatatgaacgggtggttccattatgcgaagctttatgcttccctggccggctgtatcggttttatgctgataaagtatggatggggtatcggtaagaagcattggtttaaggcgttcccttttgccattgtggcaattaatattcttatcgctgtcgccagtgacttcgaatcggcggcaaacggctggaattcctggtggatgtcgtctgaaagcgtatggctgtacggcggctggcataacatcatgaatggtatcgcaggcatactgaatatcttatgtatgaccggctggtgggcggtatatgcctccaaggataagaaggatatgatctggccggatatgatttgggtttatatcatcgtttatgatatatggaactttgcctatacctacaactgccttcccacccatgcatggttctgcggtgtggctctgctgctggcgcctaccattgcagccctcttctggaataagggcggatggatcatgaaccgtgccaataccctttgtatgtggtgtatgttcgcacaggtattcccgcttttccaggaaaccttcccggacggcacggctgcatataattgggccactataccggtacagtatgcggacggcacgatgaacggcattgcggccggcggggctgccaatgcgaatcccacggcaatgcttatcgtaagcgcgctggcgctgcttaccaatgccgctgcgctgggatatattatttacaagtctgtgaaaaacaagaagaatccttatacgggtgaagtatttacggaatttaagtattataaggatgcactggcaagagcggatgtgaaataagcccggaagcgggaatgcgggggttcataaagaaggatacgacagaacggtcatgcgaaggcatggccgttttgctatgtaagatattcgggttatacattaggcattttggagacaggcgccatcagtacctttccggtaccccggtagacatttaccagaccttctcctgaagcggcggagcctatcagggatttgccggaacgttctaccgtaaactggagacttccgctccaggcaatggccatattgccatccactttcagcacatcattttgaagggtgatttccaccagttcttccttcggacagtctgcttcaagacagaacacgccgctgccgttcagactcaggttaaacaaaccctctcctccggctacggcagaggaaagattggaacgcatgacagctttatgctgcagcttggaatcacaggcgaggaacagtccgtcgtccaggactacggaacctccccagtcggcggcttccatcagaataagatgcttataggtaggctccagaacgaggatgccatccccggtatattccggtttgatggccgattcgccggttaccttgccccgtacggcttttccgaataaatcgcctacgcccttgatgccggtggtagcgtttacgtttcccagcatccactgcatggctcctgcctgcacggtaacgtttgctttgctcagatcacagaccacctggcgcttgcgcacattcattttgctgcagaaataggcggctgcggcagaagagggcattacactgagatcacgttcgtattcgactacggtaaaggggccggcgttggccagcatgttaatatcgtcgttatccataaaattagaaatctgatacattgggaacctccttttgaaagtatgatataaataaattctagcattgtgtggaacggataacaaattaagatttcatgaaggggggattcgggattaaatgtcttgtacatacaggtatgatatttatgagattctttcttggagctgcgcttatttgcaatccggggacggtatgttacaataaactacacatgtgtttgatatattcagaaaaataagaggctcagcaaaggaaaaaacaatggaagaaaaaacaaagctgtttggatataaaaattcagtcacggtcaaaagcctggccctgatgattattctcagcacggcgattctgttggggatggagcttatcagtttttattatatgagtgtctatgaaaagagcaccatggaaaattaccgtaattcgctggaaatgtactgttcctattgggacaataagctggatatcatcaataattcccttcttaccgttaccagttcctccagcagtgacagctcctattcgaacgtctgtaattccagggatgagctggtgtttcagacggccaaaaagctgctggttaaccgtatgtcggatattgcatggaaccacgagaatgaagtgctggtttttgtttatgttcctgacagagaggtatttctgaaatccgcaaatcatctggtaagctatgacaaacggctggaaatggatcaggatatcaagaaatatgcttccggcatccgttcctataattcaacaaaatgggattatttcaaaagcgggacagaagacttttttatacaggtataccggatagacggcgggtatataggcgctctggttaaatgccagacgattctggacggtgtggtacaggataatggaatggtaagcggcatcgggcttacggatgatgaagggaagataacctattcgctgcgcggggaagccggcggcgaggaaaaaaaggacacggcagtgctgctgatacccatgacacatattgacggtcagctgaaggtagaagcgcagcggcagaatcttttcggggataaaaccacctttaccttcctgtcgctgataaccgtatccctcggtctgcttcttttggcctggaatgtccgttaccaggtgaaggaggtgctgggccctctgaataagctgcgcagtgtcatggagaagttcagccgggggaatctggatgtacgtcttgaggagaagaatacaaacagtgaaatcgatgtcctgaaccatacctttaatgagatggcggagcagatcgtggatttgaaaatcgatgtatatgaagcggagctggcaagggaaaagacggagagcaactatatgcgggtacagattcagcctcatttctataccaatattttaaatctgatttacggactggcacagcttaaggattttgcttccattcagaagctttccatgaccacgggagcctatttccgttatctccttggagaaaagggaaccttcgtcctgctccgggaagaaatccaatgcgtgaaaaactatatccagatacagcagatccgatataaggatgaaatggaatttgaactgaatgcggaagaagggatggaaaggcagatggtacttcccatgatactgcagacctttgcggaaaacagtgtgaagcacaatatcggcctggttcctctccttcggatccggatagacatatcctccggaaatgacaggatctatattaccgttagggataacggcgccggatttgaaccggatatgctggaaagaataaataagaatgagaatataagcaataaaggggaacatatcggtattaccaatgtaaaggaacgtctgcgtatcttttatggcgatacggcgagcgtggaaatcaacagcagacccggagaaaccctggttaaggtggttctgccggagatacttacacaggaggagcgcaatgaatatcatattggtggatgatgaaacagctatgctggacattcttcagcaggtaatccaatgggaagagcttgggatcaaaaaggtatatacggccaggaatgcggagcaggcaaaggaactgctgcaggaaaagaaaattgatattacgctgtgcgatattgaaatgcccaaagaaagcgggctggatttgatcgaatggatacaggggctgtatccgtctgtagtgaatatcatactcacgggacatgcagattttaattatgccagaaatgccatttctcttggggtttaccgattccttttaaaacccgtatcctttgaagaggtagagcaaacggtgcgggatgcagtggaaaaaatagaaagcgagctggttcccggcgacaataagacacagggcaaggaactgagcgctgtggaggaagtgaagaaatatctggaaaagcattataacgaggtcattaccagaaatgatgtggaaagcctggtgcatctgaaccgggactatatcaacagagagttcaaagaggctacgggctatactcttatggaatacattcaatactgcagagtctgcgcggcgaaaaagctgctgagggaaacccaggattcggtatcggaaatctgcattaagacaggatacgatcatcccgcttatttttccaaaatatttaagaagagaaccggtttatctcctctggaatacagaaattccacagaaaaacaggaaaagtctgttttgttatgaaatgggtctgatttaaggtggcggagggaagtctgtatttttataatgaaattatcaaatccaaaggcgccgttggataaaaagaaaaaggagtgtatttatcatgaaaaagcgaatcttatccttgacctccctcatgctttctgccgttcttctttttacgggctgcggctctgccaaagaggatgcgggaactgcgcctgcgagtgagggcacaaaaacagaatcacaggcttccgatacttcggctgatacagcctccgatgcggatacaaagcttcgtgacggaaatatgacagagcttcgggtggtatttcccggaggaacctcttccccggcggatctggaagccgtggaagcgggaatcaatgaaattgtaagccagtatatggatgccacagtgaagctggatattttggaatggggtgttttttcagatcagcagaagctgatgctttcctcaggagaggacatcgcgctgatgttcacttttgattcttccaagaactacgccgccaccaatcaggtcagggacatcacggacttatgtggtttgtatgcccaggatgctctggacgggctgggaatttatgccgaggcgtgtcagataaacgggaaatactatggccttcccacctttcatgaatatacgaaaacttccggcctggtatgcaggacagatatcctggaagaactgaatattgatccttcttctgttaaaaactgggatgatcttgaggctgtcctggcaaaggtaaaagaggcgcatccggaaatgaatgtactgagccctgtggaagtaggctccggtatcctggattattacaatgaagggaaattcgatgttctcacagacggtatcggtgtcagaatggaagaggacggaaccgaagtcctgaacatgtatgatacgccggaatttatggaactggccaaactggcctatgactggaataaaaaaggatatttcatggcagatgccacgactgtgaccgataccagacaggatcttctggcagcaggcaatacattcggctatatcggccagatacatcccggcacggcaacccaggaactgaaaaattcaggagtgcctgtaaccacaatccctgtgggagaaaaggctcttacgacaggaaacgttaattttgcccagtatatggtacctacaggctgcagcactcctgaaaaggctgtgaagctgcttgatatcatgcttaccaataaagatatggcgaaccttcttatgtatggtgtggaaggaagcgactatgtcataaaagatgaagccgcaggtgtcgtaggttatcccgatggagtggacagcagcaatgtaggctggaacaacgaaacctggctggcaggaaacggcgccctggcttatgcatgggaatctgattccgcagatatctggaaacaatacgaagaatttaatgccagcgcagtcacttctcctctgtacggctttacctttgacacgaccaatgtgaaaacagaaattactgccattacgaatgtgattaagaaatataaggcagtgatctgcgccggatattcggaaccggaggaagctgttgcacagatggtatccgaactgcaggcatcaggcattgaccgtattgtggaagaagctaaaacgcagatcgatgcatggaaagggaatcagtaaatagaatgactggaaaccggaatgtgaaataaggtttcgtaaaaagcggtttctgccggaataagccgggaagccgctttttatgcgaagggaaaggagactgccttaacatgcagaaaaaagcagtaaaaataagaaaatacctgcccgtttatatcatgcttctgccgggctttttatatcttttggtaaataactatattcccatgactggtatgatcattgcctttaaaaatgtggattttgcgaagggaattctgcgcagcgactggattggctttaaaaattttgaatatctgttcaaaacgccggacgcgttccgtatcacgagaaatacgctgctgtacaatgtggcttttatcattgtgaatctggtaatcggcgtattgttcgccattcttttaagtgagctgcgttcccgtatggcggtgaaggtttaccagacggtaatccttcttccgtacatgatctccatggttattgtaagctatctggcctatgcgtttcttgcgagtgacacaggactgctcaatggagtcctgaccactttgggctttcagaaaatatcgtggtacacgcagcaggaatactggccatttatactgatttttgtaaactgctggaaatatgtgggttacgggacggttgtatacctggcttcgattctgggcattgaccgctccttatacgaagcggcttctgtggacggaatctccaaattccaggagatccggtatattacggtgcccatgataaagcctacaatcattactatggtactgctgaatgtgggaaggattttttattcggatttcgggctgttttatcaggtgccgatgaattccggcgcgctgcttaatgccaccaataccattgatacctatgtttaccgcgggctgattacgctgggtgacatcggtatgtcatcggctgccggcgtttaccagtcggtagtcggattcctgctcattatggccgcaaactggctgaccagaaaatacagcaatgaaaatgcgttgttttaggaggtgtctgtcacatgcataaaaaagaaatccggtttcagctgttgtgccatatcattatggggattgccgccgtcgttaccatactaccgctgatccttctgtttatttcctcaataacggcaaacaaagatattacgctctatggctattcttttgtaccgaagcatttaagcatggaagcctactcctacatatggaatgaaagaatgcagattttcagggcttattttataactgtttttgttactgcggtgggaacgggcgtggggctcagtatttccgtcctgtacgcctatgcactttccaaaccctattttcctgggaagaaatttttcagcttttttatcctgtttaccatgcttttcaacggagggctggtgccttcttacattatgtataccaggtacctgcatatgaaaaatacgatcctggcactgataattcccgggcttttaatgaatgcattcaatgtcatcctgatacgcagctattttcagaataatgtgccgctgtccctggtggaagcggcacagatagacggggcgtcggaattccaggtggtgcttaaggtagtgcttccgatgagtaagcccattatcgcaacaataggcctgtttataggcgtagcctattggaatgactggcagaatgggttatattatgtaacagatgaaaagatatacagcatccagcagatattgaacaacatgctgaaaaacatcgaatatctgtcaaaaaatgcgacttccgtggcaaaatccacatcgcttgcaggtacgctgccggcggctacagtaaggatggcgattgcggttatcgggctgcttcccatattggttatttatccttttgtccagaaatattttgtgaagggaatatcattaggggcagtgaagggataagcggcgacaggaaaggagaacagaatgagcctttatcaggataaaaatgcttcccctgcggacagggcggaggacttactgaaaaaaatgagttatgaagaaaaagtggcccagctctccggctataatccggcaggatggtcggcagatgattttgaaaaagattatccccttggagcagggcaggtttccttttttgcagggtctgaaaaaaaggatatttacgaagcggcggcgtttcagagagagcttcaggagaaaattatggaacggagccctcatcggatccctgctattttccatgtggaaacgctgtgcggggtgatgcttccgggcgccaccagctttccctccggcatcgggcagggagcgacctttgatccggtacagcagaagaaagcggggaaactgattggaaagcaggcaaggctggccggcgcctcacaggcatttgccccggtgctggatatttccagggacgccaggttcggaaggcagggggaaacctacggggaggatccggcgcttgcctccgcgatgggaagcgcttacgtgcagggaatccagcaggatggggatctgacggaaggcacggcggctacagccaaacattttctcggatatcatgattctcagggaggaattcacgcggcagcctgcgatataccggaacggctgcttcgggaaatttatgccaggccttttcaggcggcggttaccgaaggaaggatgcagggaattatgccgagctacagctccgtcaacggggttccggtggcctgttccgaagaaatcctgacaggccttctgcgggaggaaatgggctttgagggcctggtggtttccgattattgtgcggtccaggaaatccatgaacgccatcacgcggcggaatcctatgaagaggccggacggaaagccctgctggcgggaatgcagcaggagctgccgtcgagaaaatgctatacacaggagacattccgtatgaatgaggaagacgaacgccttcatgcctgtctggatgaggccgtcaggaaaatactgaccactaaattcatgctgggtctttttgaaaacccttttgccgcgccggacgaggaaatcaggaaagagtacgagaatcccaacagcacggaaataacccgcacatcagcgctggaatcaatggtgctggtaaagaataacgggatcctccctctggaacgaaagaaacagacaatagccgtaatcggttatcatgcggctgcggttcttgccatgttcggaggctatacctacatgtccatgacggaatccgccttaggtgctaaaaacacgatggcaggcatggaaaccggtgataatggggaaggtttccgggaaacgtattgcggcactgtcgtggagaaggaacatcccgatacagaaaaactggcaaaagaactggctccttcggtgaataaccttctggaggaactgaagggaagagtaccggaaaccgatttcctgtatgcctatggatatccttatgccggaacggactgcagcgcccatgaagaagcgcttcgggctgccgaacaggccgatgtgattctgatgacggtgggtggcaaatacggaaccggtacgaccgcttccatgggagaggggatcgacggtaccgatatcaatctgccgctttgtcaggaagaattgattcagaagatggccgggcttggaaaaccggtggttctggtacatttcggcgggcggcccatgtccagcgatgcagccgatcaatatgcggatgcaatactggaagcatggaatccgggagaaaaaggggcggatgcggtagtgagcgtcctgttcggggaatataacccggcaggaagaatgcctgtgagcactccatacaatgcaggccagattccggtatattataatcatccttacggctccggataccatcagaatacgatcagcgcattccggcagtatatggactgccctcatgagccaagatattattttggccacggactgtcgtataccaccttcgcctataagaagatgcagataaggaaccgccgtctgcagccggaggatgagctggagcttacgcttgaaatagagaataccggagagcgggatggtgaagaagtagtgcagctttacatacgggactgctatgccagtatggtcaggccggttatggagcttgctggcttctgccgtacttttatcagggcaggggaagtaaaaaaactctgtttccgtatgaagctcagtcagtttgctttccttgacagtcagatgcggtggaaggtagaggccggtgaaatggaggtgctggcaggagcgtcggccggtgatatacggctgaaggaatccgtttttatcgaacgtgattcgtgggtggacggcaagacaagaggcttctatggaagtgtggaaattacagactgaataactgagaggaggaacgtataatggaaataagaaatccaataatcggggcggatatgccggatccggacctgcttcgtataggagatacgtattacatggtatcaacgaccatgttttatgtccccggggcgcctgtactgaaatctaaggatttatgccactgggaaatcgtttcctatatttttgatgtgctggaggataacgaaatataccggctggaaaacggcaggaatgcttatgggaaagggcagtgggccacaagtctgacaagatatcaggaccgtttctatgcctgctttgtgagccatgactgcgggaaaacctatattttttcttccgatgacatagaaaaaagcggctgggatcgtgtggaaatcaatgaagtatttcatgatatgtcctttctgttctgggagaatgttccctatctggtatatgggaacggggatatccggatcgtggagttgaaaagagatctgagcggggtacaggaaggcggccttcaccgtcttttgctgcagaccgctgcagaaggcatgatgcttcggtgtgagggctgccgtgccatagtgagaaacgggtatatatatctgttgtttattgactggccgaagggcggaaggcggcgggaggtctgctatcgttcccaaagcctggaaggaccctgggaattccgggtattgctggatgacgactgtggcctgccgggctgcggggttgcccagggaacgctgatcgacagtgaatcgggagagtggtacggaatgctgtttcaggacagaggagcatccgggaggattccgtatctgatgcccgtacaatgggaagagggctggccgatgttcggcgtgaaggaagaggggacgaaagaaagcggagaaggacagccggtatggaaggtgccgcggacgtttgaactgcccttcgcggctgttcctgctgcgcccgtggcggtcagcgacagcttcagccatgaggaaaacaggctgggaccgacatggcagtggaaccataatcccattccttcctgctggtcgtttacagagaggcccggatggctgcgtctgcagaccggacatgtggcctccggcctgatggacgccagaaacacgcttacccagcatacggcggaaccgggctgtgtctgtgaaatagagatggatgcctccggaatgaaagaaggagactatgcagggctgtgtgctctgcagggcaggtatggccaaatcggcgtatctatgaaaaatggcagaaagtatctgtctgccgtacaaaaagatgcccagggaaagctgtgggagacggaaaccgaactgcatgcggatacggtatccctgcgggtgctttttgactacagggacggaaaggatcaggcagccttcttctataaagagaagggagcggagtgggtgcggcttggaaatatactgcagatggcatttactctggatgtatttgtgggataccggatcgggatattctgttatgcgaggaaagaagcaggcggatatgcggatttccgtgattttaagattcatatgatggcggacggcggaagctgcgaagaatgattccggcggaggaattttgattgccggtgagccggggcagactgtcttgtcagcgatggcaaagctgtttatttcatcgttgacaaggacggctggcccggctgtctgatatacggattatacgcatatctttgctgtattcttgtgaatgaacagtcggcagaacctactgctttttttcaacaggtatctacagctcacacttatattgcaaagaccgcatatccccgatctcagccgcattaatataatagatataatcctcaggaaggggaactgcctgaaagttaggattacagcagccgcatcgccagatggtcttatcctgcagggtataagtaattcctgaaacacattctgtccctcttttttggcagcccttatcactcactaagaatgtattaaacacacgttccggacagttttttatataatcgagcgccttctccacattggatatacgaaagtataaaagaaggttcgtatccatgctggtgagccagaatcttgcatttgtatttctcttacaatcggcctcacttttataataccttatttgcgggccttcattccaggtctgcctgctgaaaaaataattcctgctgagcagttccttatgtatatactgtgcggataatttgtcctgttccgatttatataggtcggaaacaaagtcaactccgtttccaaaagctgcagtgttccagtcatctgcgaacagtttataatgcagccggaagaaatccgtcagtctgtttgtacatctgacttttttggccatcagataaagaacatccatgagatgcgtattgtttaggtatcgaactgtaatatcctctgttcctttttttatccgccctgtttccaaaccttctgctgtaaatccgtagttctcaaggattgtcaaatgcctgctgatatttgtcaccttgagttctttacataatctatttaactcattgacgtttaccagcagcccgcatttgtgatcaggttcccctgaacagcctaaagcatataaaagcttcgcatatttataagaagcctcccgtgaaacccgggtctccttcgcaaaataatcatattcctgcatgtcgaaaagaggaagaagcatcccttcggcatcctgggccatatcgccgtatattcgatgcaatacttcatacagttcgctgaagcccctcattatatcatccgggctgcacagcgttgtgaattcatcatgtatgaagaattcttcagggaagtcaaccatctctttctgccttaattctgcccatctttctgcccaatatttcataaatatctcctgttctgaactggtgaaaacgcttagtcttcaggactcatccggttttatacatctttcgaaaaccatgacggtctgatctatggtggcattcagattaatttgtatgaacatcattggtgtaaccgttttaccgacttcattggtaaaaatagtatgaagcctccagcctttttctgcgtattcaagaagtgcccgctcaacggcggggccgtctatttcaccggtggataaatcatttataatgactgttttatattcgtaaagggcattctttttgagctgtgcttccttctgccgctccttttctctctgcttttcttctctttcctgttgcagccgttcatttgcatttcgcatatccattacttcattaggattcatgactcttttatagataaaattgtaatggcagttgaaacattcttttacatcatctccgacaagttcttcgcagttaggacactgtttcataggcgttacctccgtgtttttttgtccaaacttcatgggtatcttagatatttattgcagctatgtgaagtttgaaatgatataccgattttatcatatatgggacgcatggtgctacagtattttaacaacgcagtttataaaatcatattttttgcatacatgaataaaaaatagaatgaattctgattgtcatatttgtaaacaaatcaattttcgatcttttttctgatgattacaggaacataacctggttacagattgcctttggtatcagaatgtcatctattcttaatgatttcagcctgaaaaggtagaaaaatgaatatccttattgaaatattactgtgttatattaatatatttaatatttatattaattattttaatttaaatgttgacattattgatttggaggtttatattatagacataaaaaggaaagaaggtgacaggatgtaccaggttatcagcagctgccctgtatgcgggaaaaaactcaaggtagtcaagcttcagtgtgaaaactgcgatacagtaattgaaaatgatttttgtctcagcaaatttgattatctcagtacggaagacctcttttttgcagagaccttcttaaaatgcaggggcaatattaaggaagtggaaaaggaactgaaaatttcctatccgacagtccgttccaggctggatgacattatccagaaactggatgggaatcccaacgtgcgatccaatgtacaatccgcctcttcttcacgcaagaaggagatactgaacgctctggaaaacggagaaatcactccggaggaagcgttggagcagatgaaggaaaactgataatacagattaaagtcgctgtaccagccggagggacaatggcagcgcggaaatgaggaaaagaatatggaagaaaaattaagaattttgaaaatggtagaagaaggaaagcttacggctgaacaggcggttgaactgctcaaagcgttggaagggactgcgccggaacaggaaacaatggattctgcagaaagcttctatgaggggacacatgctgttcccgaaaacatcccttacgagaacaagatgcttcgcataattgtagacagctctgccggggataaagtaaatatccagcttcctgtaaagattatacggcagatgcttatggtgacaggaaagctgcccattaaaacggaggagctggaagggattgacctggaagaacttacgtcatccattcttgaatgtattgacaatgaaacacttgggaacataattgaggtaagcagttctgacggtaccacggtcaggatctttattggatagtgccgggagggtgaattcatgcgcattattatccgttcaaaggatgtgaatatgtggcttcctgttcccctggttctggcagatgcagcggttcggtttctgccggattcggtaatggaagaaataaggaatccgattccgtctccctaccgggaggtgattaccaaagagcttcttcaggaactggtaagggaatgccgcaatgtttttaaagaatacaaaggacttgagattgttcatgtggaagcacaggatggtacgtttgtatcaatacgtttataatttgtatcgatatgtttataaatagaaatgcttattgaaagatatgggacagaaggaaaagcggggagctttttcgtctgtcccatttatttcatcaaacattctttttacctatagatatgtatatattataactatttgctggagacatataatgcatctataatgatagcagaaggagctgatttccataagcacaagctatggaaatttatgtacgaatggaaaaggagtgaacagcagatgattaccaaaacatttcagaatttaaggctttccgcccttggaatgggggctatgagattaccggtagttgacggaaatgatgcacagattgacgaagccgaagcggcccggatggtatcctatgccatggagcacggcatcaattattatgatacggcctggggataccatgacggaaattcggaaacggccatggggaaaatactggcggcctatccccgggacagctatttcctggctacgaagttccctggctatgacctttccaatatggataaggtggaagagatttttgaaaagcagctggaaaaatgcggtgtggagtattttgatttctatttgttccataatgtctgtgaaatgaatgtggatgcctatctggatgagaaatatggtattctggactatctccttaagcagaaggaaaaaggacgtattcgccatctgggcttttcggctcatggaagccgcgaggtaatggagcggtttttggacagctatggaagctacatggaattctgccagattcagctgaattatctggactgggatttccaggatgcaaaagggaaggtggaactgttgaacagccgtcatattccgatctgggtgatggagcctctgcgcggcggaaagcttgcctctctgccggaagaacaggaagtgaagctgaatcaattacgcggggagaaaaccccggcatgggcgttccgctttctgcagacggtaccgggtgtcaccgtcgtactttccggtatgtctgattttgaacagatgaaggagaatatctctacctttgaagaggataaacctttagataaaaaggagtgggaagctttgctgggcattgccggagagatggtaaaaaagattgccctgccctgtaccggctgtcattattgtgtaagccattgcccaaagcagctggatattccggctttgctggagctgtacaatgaacatagctttaccgggggcggtttcattgcgcccatggctctgatggctgtgccggaagacaagcatccggatgcctgtattggctgcagaagctgtgaagcggtatgtccgcagcagattaaaatatccgaagctatggcggattttgcgtcccgtctgcagggataatacatctacaaggtactcttgggaaatatatagtcctaaatagtggagcctatgactcgtgtgtgtcataggctccactctataccctaaaccttactataaattaaataatcagatatctgatattgtataaaaggtgacagcttaattatgaatgaaaaaacaactgtattctggtattatatatagtattaatactaatttattaaatacgagtccggaggatgctatgattaagaaaataaaaagaaaatataccgatcagacgctgcatcaaaaagtaaggctttccattttgcttttttcactgctgcctttgctctgtctggcatgtatttctcttccgctcatttataaaaatcaggttggcaaaatccaggaggaagtatatgaagaacttcagaacagaactgacgatatgatctatgaaatgaatacaatagaactgatggccaagacggtatggtctgatacaacctttattacggaggtgggaaaggccgctattgacggtagtctgggagaatataaccgttatatttttcaggaacagactttgtcggctcttagggtaattaccagtattagccaggtacaaagtgcgagaattcatttggattatccgggtgtccgggaatattcttcttatttatatagtatggacagagcgaaggacagtctctggtatgaggacagaaattcccttacatataatggtgcatggtacatgaatgtaacggataagcagtcttatggaacctattcggattattttacagagaaaaatatggcttcttttgttatcccgataagaatcagcagtgaactgaccggcatttttgagattatgctgccaatgaaggctattgtgccggaactatatagtgacctgcagaatcaggatatatttttgattgattcaaaaaacaggattttaggaatagaggccgagggaaagtttggaggtattaccagggaaaatctggaggcaatgatgggagttgcttcactggatgattatgatgcacagggaatacaaatttatcatggtgtatggaagcattctccggtgattctgtcggtaagcagaaatgaaagaaagggtgtttatctgatggagattacctccgtgaagaaacagtatcagactatggctgtgcagattataggaattctgttgatagaagttctgatgacggttcttttgcttaaagctattaatcgtattgtaaaacgtttgctgcatgattttgatatcttttccgaatgtatgaggaaagtggaaaatggaaatctggatgtggaaattcccagactggagcaggtggaaataaatgcggttgcaatggaatataacaggatgcttggtaaagtaaagcagttgatggaaatcaatatccatagggaagtaatggtaaaagaggcacagctcagaagtctggagaaacaaatcaactcccattttctctataacgtattggattcaattaagatgatggcggaggtaaaagggatttacaacgtatccgatgcacttttggcactggcaagaatgttccgctataatctgcggattgacagccacagcgttacattgcaggaagaaatttcttatctggaaagctatttgaagctgtgtaatataagatatgattactatattaatctcagtgaaaatgtggaagatcctgcaagaaatcttaaggttcccaaagtgctccttcagcctattgcagaaaattctatttcctatggactggatgaactggcggaggatacaacaatctatttgaaagcttatataaaggatgattgtgcttttatagaaatgactgatatggggaaaggaatggatgaggaaaagttggagaaggtccgggaagtgattcgcagcggaggcggaggaaataactcaacgaacggaatcgggctgcataatattcatgaaagaatccggctaatgtatggagaagaatatggtgttgaaattttttccagagaaaactgttatacaaaagtagtgatgacaatacatgcggaggagatagtatgagaaggattttactggtggaagatgaaaaaatgatccgatatggaatttatgtaatgattgagaacagcggagttccctacaatgaaataacggaatgccgtaatggaaaggatgcagtcgaatatttgaaaaataccagatatgatcttgtcctgacagatataaaaatgccgataatgggaggactggaactttcgaggtggatatgtgacaatctggatgaggaagaacgtcctctcatagttgcaatcagcggttatgcagaatttgaatatgtgaaaggtatgatgaaatttcagtctatggattatctcttaaagccggttgacagggaggaacttggaaagattctttggaatgcagaagaaattctcaggaaaaggagtgtggaaagtcctgatatgggaaatcccggtgatacggaggttaccggtgtaagcagatataaaatgcagagggcgattgactatatcaggcagaactatggaaaaccgatagatatggctgaggtatccaattatgtttctatgaattattccatgttttcaactacttttaaagaatttacaggagaaaatttcagttcttacctgagaaagctgcgtattgaaaaaagtaaaaaattactcttaaacacggatatgagcattttggaaatctctcagaaggtcggttttgaggatgcaagacgttttgcgaaggtattcaaagaagaaacgggactgacacctactgccagcagagataaaatgatggcagagaaaaaataacacataaaacaaaatctgacccatttttcgccaggcctttttccaatataataatctcataatgatgtcgacattaatattacaggtactaagagtatgtatcaggaaagggagaagaaaagtgaaagcaaaaaaatggttggcactgattctggctggctgtatgggaatatgttgtctggcagggtgtggtaattctacaggtaatggaggtaagacctctgcaaatgcagatacagcggtacagggcagggaaagttcggatgcggaaaaggtgaagcttacagctttgatttccaaacatagtctcacaaaagatgtaaatgagatggaatggctgaatctgctggaagaagaaaatggagttgatgtggaatggcagcagataactgcagattgggatcagaaaaaaagtgttatgtttgccggaggagatattccggatattttggtcaaagcaacagttacgacagattttgcaacctataatggccttttcgagaatctggctccttatatagattcaggtgaaatgcccaatgttgctaagatgtttgaggatcatccggagctgagagtattaagtacagatgaaaatggtgcaatttatgggattccaaattacagaagtctctggccaagaacaaacagggtgctgtatataaacaaaacctggctggataatctgggattacaggtaccgacaacaatggatgaattggaagaagtccttattgcattcaaaaatgaagatcccaatggcaatggagatacaaaagatgaaataccgctggatttttccgggtttcccacttttatgctgggatgctttggggtacccatgatgaatgaaagtgatggttatttcgtagaagatggtaaagtaaagaattatcgtgtggatgaacgctataagacctttatgatatggctgcagaagctgtatggggaaggtttgataaatgaagaagttattacacaggattattctaagtttcaatcactggcacgcggggagggaagtaccgcaaaagttggtgttacccttggttgggaaagcggagatcgattcgggactggtgtggcagatcagtatctgcccctgccggcattgaagccgcatgcggattccgatgaaaatgaggtttattggggctattattcggataataactcggttaatgctgctacagcagccttaagtgcaaactgcaaaaataaagcggaagctgtgaaatttattgatgctttttatgcagaagatataggaattcaagttttgtttggcggcatgaatgatgtggataaatgtcttcaggataatggggatggaacctatactgttcttcctcctgcggattccagtattgatgcaggtacatggaaatggacaaattcctttgcagattacagcccttattatattccggatgatatgaaagataagctgacaatgggtgaagatatgcagagagtccttgaggaaagaattcctcttgaagcaacgctggatatgatggagaaaaaatgtgagacttatccggccaaattcataacttatactacagatgaaaactccgatttggcaatgacacaggctaatataaataatattgttgatcagacatattccgcatggcttacggattcttcgagaaatattgaagaagagtgggatgcttatgtacagtctgtatatgacattggtctgacacagaatctggaaatcagacagactgcgtatgagagatatctgacatcgatgaagtaatctgaagaattcaggagccgggaaaacatatagagttagttttcccggctcttatcagataattaattaaaaaaataccaatggaggtatgctatgggacgaaaaattttgtctggtttaaaaaaagactggcagctttgggcaatgatattgccggctcttgcctatattattatattttgttatgtgcctatgtacggaatacagctcgcatttcgtaaatacgatttttccaaaggactgactggtggtgattgggtagggtttaaatactttatccaatattttgaaagtcccatgttctggactactcttagaaatacttttgttatttcttttttcactctggtatgcggatttcctgctccgattcttttggctctggtggttaattcactgagacagaagaaattgagaagggtagtgcaaaccgcagtatacatgccctactttatttcaacggtggtcatggttgccatacttcagattttgctttcaccttctaccggcgtagtcagtaatcttcttaaaagtttacatataataccgcaatcaataaatctgctgggcactcccagtgcttttgtaccggtttatgtgctgtcaggaatctggcagtctgccggatggaacagtataatttttatagcggcgctggcctctgtggacgggcagctgtatgatgccgcaaaggtagatggcgctaatcgctggcagcaggtgatccatgtggagctgcctgcaattgttcctaccattgttatactgttgattatgaatatgggacgtgtgctgagcgttggttttgaaaaagtattcctgatgcagaatgacctgaatctgtcagtatctgaagttatttcgacttatgtttttaatataggcgtacaatcggggcagttcagctttggatccgcagtagggctttttaatacggttattaactttgcatttctgatgattgccaatatggtgtcgaagaaggctgcggatatcagtctgatgtaggaggagagaaaatgaaaacagtaggaaagagaatgcagcaaagcctgtcagaccgtattttttatattattgcaacggtgattgcagttgccgcattggtgattgttttgtaccccatgtattttattgttattgcctctttcagtaattctaatatggtaaatcaggggctggtatctttgctgccaaaggatattaatttttatggatatcgcaaaatacttgagaggacggatctttgggtaggatataaaaatacaattatttatacagtatgcggaaccctgctgaatctggcggtgactcttccggcagcctatgtgctggcgcagagcagattcagggcgcgccgtgttgtgatgccgctttttgttataactatgtacttcggaggaggtatggtacctacatatatgctggtgaaaacactgcatcttaccaattctccgctgattatgataattatgggagcggtaagtgtctacaacgtaataattacaaggacttttttcgagaattctataccggcagaactgcaggaagcggcggaactggatggctgttctcatttcagatattttttgtccatagtccttcctttatccaaagcggttatttctgtaataacattgtattatgcggtaggccactggaatgatttttttaatgcgctgctttatttgaataaggatgaataccagccgcttcaaacgattctgaggaatattctgatcagcaaccaggctatggcaggtaccacaggcgcaggagaagggagctatgcacagcagtatgcggatcagattaaatttgctgtgattattgtttctacagtgccggtattgtgcatctatccgtttatccagaagtattttgaaaaaggtgtgatgattggagccgttaaaggctaatcatgtaaggagagaaaatgaaaaaagccggagattttgtcctgttggaagcaggacaaaagatacgtattatttattctgaaaaagaaaacagcgcggtaaaatgcgcgattcagaatttggccgaagatataaaaaaagtgtgtgactgcgttgtggaaccgggaaatattaccggaaggaatgctcaggagaatggaccggagataatcgttgctactatggataccccctggttttctgaaattatgcctgtagcagttttgcctgctttggaaaaaataagggatgcacagggagtgggacgctgggaagcatatctgcatcagatttccgataattctttctgtattataggagcagaccgaagagggactgttttcggtatttatgatttaagtgaacagataggggtatctccgtggtatttctgggcagatgttcctgtaagaaaaaagaagcattttgctttttcaagcgattacagtaaagcggactggccggatgtacagtacagagggattttcctgaatgatgaggaagaactggatgcctggtcaaagatacatacaaaagatgatacgatcggtccggaaacctatgcacatatctttgaattgctgctgcggttaaaagcaaactatatctggcctgccatgcatgtgaattactttaacagtaaccctgaaaacggaagactggctgagaaaatggggattgttgtcggaacatcccattgtgatatgctgcttcgcagcaaccagaatgaatggactccatggctgaagaaaaaaaactatgagaatatcagatatgattactcgctttccggagaaaacagggaaataattcaggaatattgggcagaaagtgtggaaatgaaccgaaattatgaggtgtgctataccgttggcatgcgtgggattcatgattcgggattcgtaacggaagtcattgatcaggatacctctctgacgcagtctgaaagaacagaaaagaagattcatttgttggagaaggtgatttcagatcagagagagattttaaaggaagtgctgggtgaagaaaaagggaataatgtgccgcagacatttattccatataaggaggttctggatttatatgacgggggcctgcaggttcctgaggatgtaacattgatatgggtagatgataatttcggatatatgcggcgttatcccggaaaagaggagcaggagagaaaaggcgggaatggcttatattatcatgcttcttattgggcgtcccccggtatgagttatcttttttttaattccattcccctggcacaaacagggaatgaattgaaaaagtgttgggaatccggtatcagaaaaatgtgggtactgaacgtgggagccctgaaacctttggaaatagatacggaatttttcctgcgctatagttgggaagcagggaagaacacaagtaatacaaaagatgtaactcagtttatatcccgctggattaacagaaatttttccggaaattttggcatggatgcggcagaaatctataatttgtttgcacagattaataatgtatgtaaaccagagcatctgcagtcggataagttttcacagaacgcatatgggaatgaggcaaagtacaggattgatatcttaaaagatttatcagacagagcggggaaaatttatcagtttcttccggaagaggaaaaagatgcctttttcgaattgtttttgatgaaacttcaggcttcttattatataaatgcttctttttatttcgcagacaggagccggtttttctgggagcagggaggaatgcaggcggcagacagctatctggaaaaatcaagacagatggatcgaaggaaacaggaactgttatattactataatcatttgatgcaggacggaaaatgggaaggtattttaacacccgaaagtttttcgcctcctccgacagtactgtatccggcagccaaaccggctttggttattggagcggcttctcttggagtcatccgggaggataattttatatttcattcgcatgggggaatagaaaagataattaccctttttaataaaggatgcggagagattggctataaggcggcagtcccgaaatggctggagatcagtgaaacagaaggctgtgttgcggcagaaaaaatactgactgttcgtatccgcgaaagcgaacgtaagatatgctttgaacagggcagaacagggcagattattattaccggagaagatggcataaggtatgaaattgagatacaggctgagaaagagacggcttatccgtatagggaacatactttttatgcggaagcagacggttatatatccatccctgccgatggatacagcgaaaatgtgtgtacgaaagaagcagcctggaggaagatagaatatctgggaagaggctggggagcggcaatggaagcatttctggaatcagctcaggacagggcaattgagtccgatgctcccggtatttcagatataagacaggattgttatctgaagtatccgtttttcctggagaacagcggtgcatttttgctggagatacaccgttttctgacactgaatccaacgggaaaagtacggtttgctgttggggtggataatgaacggcctgttcttatagaaacggatacggttgatgagtggaagggctgctggaagaatgctgttatgaatgatggggaaaagctctatcatatgcttccctggctttcatcaggctatcatatattaaaaatatatcctgtggatcaatatgtgacgctgaacaaattggttatctatacagaaaaatggaaggagagtaatttcggcccctttgagagtgctttttatgatggaataaagtggaatacggcgaaaggagcagatatgattccggtaaatacagaagaggatcgctcaggcttctggagggaactttatgggaatcctgctgacagggaactgctgcttccgatgctgtatgcggcaccggatttttggaaaacggaaaggctgtatacacgcagtgacgagaaagagaaccgtttgggagccgtcaggtacacatgctgccaggatggtacgaaagatatattgcatcaatttggggaaggactgtttatggaggttgacggaatagcagcttttgaagcggagtatgctttagaaaactcagaaaatgcatatgtaacagcctctgttccggatggaaagtattattggagccatacccaggcagaaacagatggcggttcaggttttgccatgatgatagagggaaaaggaagatactgggaaaatgcgctggaggggccgggattgcattatcggattagaatacagaatccagggacgtattttgtatggctgttgatgaagtttgaagatgcagacagtgattcctgttatctgttagcagatggaatgcagcaggatgcagaccggatattttcttctcatggaggattttttacatatagtatgaaacaaagatggcattggcgtgcagttgctgctttggatttgaatgcgggggaacatattttatctgttatgggtaaaaaatcagggcttcgtattgaccggatttatatgactcaaggcaatgaatggccgccggtagatgctgattggagggaaagcagaagaattctgtttgagtaggagattgtgccgataccgtcatctgtgccaatcgccaaaagttgccaggaatgctcttttagtgttatgattgcatcagtacttaccgttcagtatgatatatgtatggaaaagcaagaggtatgcggcatggaaatcagaacacttcgctattttttagcaatagtccaggaaggcagcataacaaaagcggcggaaatgcttcatattacacagccaacgctcagcagacagatgatggatctggaacaggagctgggaacagttttgttgattcggggaaaacgttctgttacattaacggaggatggcctgctgtttaaacagcaggcggaagaaattgttgatttagccgacaaagcagaaaacgcattccgcgataaaacagaaaagataagcggcaccattgcaattggggcggcggaagcattgggaagccggatactggcctcttatatgaaaagattttctgacaaatatcctgatgtgcagtttgaactgtataatgaaatggcggatcatatcaaggataagattgacaagggaatactggatatagggctggtattggagccgattgatacgagcaaatatgaattcatacgtttctcaggaaaagaaacgtggggcatcctgtgccggaaggatcatcctcttaccaacaaggaacgtattgcggtggaagatatcaggccgtatccgctgatcctgccaagccgggaaaaagcattgagtgaggtgcttaactggttgggatgcgaggaaagaaatttaaaggttccggtcaagtataatctgttgtccaatgtagctcttttagtggaagcaggcatggggtgtgcggtatgccttgacggggcattgtctatccattacagtgaggagctctgtttttgtcctgtttatccggagcatactacccggtgtgtgcttttatggaaaaagaaccggctttttcaaccggcagcttcactgtttatacaaatgctccataatcgcttgtcagaatgacatggggccgcgatatcttcctctgaagcatggaataattatagcctgctgcacagttaactgtgtgtcaggcttattggttagttgaaaagttaattgcaacacaggctgttgcagttagaattacctgctgcgaaagccagagagttgcagtaatgacctcatagctttgtggtctggatatcattagggtataatgcttcatgtcctgccttcagattggaggagtacatgaacaacaaacaccttacatttgatgacaggctggcaatccaggcagggttacagcaggggctgaaggttgcgcagattgcaaaaaatattggcaaggatcgcgcgactgtaggccgtgagatcaaagcacaccggaaactggtagccacctcgaaaggcaacagctgtgtccgccatgatacatgcacgaaggttccggaatgccggcagggctgcttccgtgggaaacgtcagtgccagacggcgtgtggtggctgcaattcgggctgcccggagtaccaggaggaattctgcagtgggtacgagaaatccccgtttgtctgcaatgcctgcgggaaccggctccgctgccgcctcagaaggatgctctatgatgcaaagcatgcacaggagcagtatgagaagatacggtcagagtcccggaggggtatttctcttacggaagaggaactggtccggatcaatgacaccatctcaccgctgatcaagcaggggcagtcaataccggctatctgcgggatgtacagggatgaactgccagtaacggaccgcacaatctattcctacatagatgcagggattctggacgcaaggaacatagacctgcggaggaaactgcgaagaccggagcggaagaagagcgggccggtcctccgggtggataaaaagtgccatatggggcgggcttatggagattaccaggcgtacatggcccagaacccggatgccatggtcagccagatggacagcgtagtcatccataaagggggccaggccatcctgacggtcctgttcacaacctgtgacctgcagctgatgtttctgcgggataggaatacggcagcgtccgtgacggagatatttaagaagctccgtgtgcagttggggggagagcgcttccaggctctgtttcaggtaattttgacagacagggggagtgagtttacagaccccaccaggattgaggcagacacagaaaccggggagatccagtgccgcgtattttactgtgagccgatgaacagcaaccagaaaagcaactgcgaacggaaccacgaattcatccgatatgtcatcccgaaaggccaggcaagggaccgctatgcggaggaagagatcagggaaatgatgaaccacatcaattcatatccacgaaaaaaatggaacggacaggctcccattgatctttttaaaaagatctacggcgaggagaccgcaactctccttggccttgagaaaatcccatccgcatccattacactaacaccggccctgtttaccaggtaagccgggattttagggaaggcaggacaggagaactatcaaaaagaaacctgtcagagcggggtgcatttacaacttcaaaaaagaagaagaaagcagtccggcttttgtgatgccgtccttttcagctattgtacacaagaaacgaaaaaaaggcaatgaaaacagcaaaataggctggaaagtgttgcagttaccctatacagcatgcagttacaatttcaaaaacatgtcaatgtgcagttacaatttcaatgttgcagtaaggatttcaattaacctgtcaggcttattttttatgcaggaatacataataggcatgatagtggatacatcataagtattagacattttaaatatctggaaatacaataaacaagaatggaggtatcttatgaagtacacaaaattaggaaattcggatttgaccgtttctcgcatctgtatggggtgtatggggtttggcgatgcggcaagagggcagcactcatggacactggatgaggagcacaccagggaaattatcaaaagagggctggagctgggcattaatttttttgatacggcgatcgcgtaccagagcggaaccagcgagcagtttttaggcagggctttacggaactatggcaaaagagaagactttgtggtggcaaccaagttccttccccgcacaaaagaggatatagaggcgggaatttccggacagaagtatattgaaaagatgattgataaaagccttgacaatcttggcatggattatgtagatctctacatttaccacatgtgggattataagacgccgctttatgagatcatggatggcctgaaccggatcgtaaaagcaggaaaagcaagatatatcggtatctccaactgttatgcgtggcagctgtgtatggcaaatgagctggcagaaagggaagggtttgcaaaattcgtttccgtccagggacattataacctgattttcagggaagaggaacgggaaatggttccgtactgcagagaggaaaatatcgcgctcaccccttacagcgcgctggcgggaggaaggctttccaaacggccgggtgagcgctcgaaacgtcttgaggaagacagctacgcaaaattgaaatatgatgcatccagagaacaggacgaattgattataggaagggtagctcagcttgcggctgagagaaatgtgtccatgacagaaatcgccctggcctggcttttgacaaaggcaacatccccggtagcgggagccacgaagctccatcacgttgagggcgcggcacgtgcggcggagcttactttaggagaagaggaaatcaattatctggaggaagcctatgttccccatcgcctggtcggagttatggcgcagaatactgcagccccgaaagcagaaaggactgtttggccggcaggggaagcagttctaaaaaacatttcttttgatggcctgataaatcaaagaagaggagaaaataaggtatgagagtccatttatgaaaaatcgtacaaattggctgtattgcggcaatcgtattgatgctgcttgtatgcggcgcaggaaagaatgagaaccagacggtctccagtatacagggtcggcagaataatctgacagaaacagagacgacagggcagacagatgatatggtacagacagcaaaagtgattattgtttacttttcctggtcagaaaatacaagaagcatagcgaatgaaattcggtctcagacaggtgcagacatttttgaactggttcccgcaactccctattctgatgattataatacggtattggatgaatcgctggtagagcagaacaatcaggcaatactggagaggataagaacaatcgaagattttggttcctatgatgttgtttatgtgggattttgtaaaatggagtatggttttaactgtgtatcgtgtatgtggtgttgaaaaaatgagattgtgatacataatataaagtatttgaaaatatgtgcatcatgttgaggaaaatatgaaaagttgatattataataatatcagctttttttatatttaagatgttaagttttatagttatcaataaatgtcgtgaaaaataatgtaattggagaataagtatgtttacggattatagacaggtacagcacctaaaaaagtgcgatgaattaattgaatattataaatcggttggtatggaaagctttattgatgcgattaaaaagagtggattaacaatcaatccatatgactctaaatggagaaataaaaagcttttccaggaaattgaagaagaattagtcaagataaatactgtagatttagcgtcatggcggcagatgttaaaagaatccactttaataaatgatttatatacaaaaatttttcagttagagtcttatgttttaacaaagaacataaggccagagaatgaatgcgcggctttcattatgctgcttgaaaaatatatgttctttatttcaaatataatggatggcaaagaaaagaagaacgagaatattaacttacagtttacaacagggttgggatatgaaaatcaattaacagatatagaacagtatgcacaaatttttgatcattgttctttggttgctgatgatatattgaaatatttgcttttttttaaagcgaaagatatagataaggcctatgaagctacagttgaagagcaggggtgggcattagagcatataaaaactgcagatgttaagtcggtggtaaatacattgactaaagaatggcaatttttcgatcgaaaaatagatgaaaaagggggaaaagttactagttcatgtgaaagttttatatttaaggattttcaaatattaaaagaaagacttgctaatagaaaatttataattcacaatgatataagtattatgcaagattttaataaagttttagatttggaagaaggaattaatagagatgaaaaacgggcaaaactttttctgaaagagatgctagccgtagaaaatttagaatataatgggattgttcaaaaaaaagatttaacatatgttgtcaaaatttcaaagctcgtgagagcatatgcagtgttgcaaaatatggtgctaaatttcatgaaatttagaacaatggattctaataacttggggaatatatgtttgttgacaactaaagaatatattctagaatgctttaccgaaaatggcatatcgttagaatctgttcaggatatttttacaatattaacacttgaaaactataaggatttttatgatacaccaattattccatataatgataagtaccttttgattccaagcatagtagctcatattgatatttcacaggctatattatcgtgtgtaaatcaatttaactttcgcggagaggcttttgaaaaaaagataatacaaattcttaaaaatagagggattatatgcgaaaaaaaattatataaagatgaaagcggagaatatcaatgtgatgttctatttttgttagatagagaattatttatttgtgagtgtaaggcatggagtgaacctcgtacaataatcggtttttataatcagttagagaaaatgtacgatgctgagaaacaactgacacgcatcgcaaataagtatgttgaggagattaatttaattaaatcggatttaaagattgattgtgaagtggaaagtatacataaggtggtcttgtcggcaaatgcgataggaaaagaaaactttattaatggcacatattacattgattattcaacttttcacaattttatacttcgcaaagcaccatctattaatttctataatgaaggaattgaataccaatataggttaccgggatttgatgaatatgaaggggatattacggcaagcaagtttatgaaatgtctcaaagaacccagttcaaataagttaatggaaataaatacagaggaaaaacaaagagtggttagtttaggcgaaacagaaatagaatataacgtattagtttgcaaagagagtatatatatggctccagatcgagatatagatgagtacactaatggtttagaaaaagtatattcattaaaatgatattttttaagacttttaaggtatctatagaaagctttgattgttcattttactatattatgatttgaatgtactgctgaaggtggaaaagtggtaaacaatagaggaaggtacaaatgcctgaacattaaacaattgaatggaaagaatcatggcatgatgattctttagaatgcaaaaataaaaaaagctactggaagtgattccaaacaagattacagatacaatgggaattgtagtggatgttaatttgcttttagaaggtttatataatatattgaagtagttgtagagaaataaccgtctttaattggctatcatgggaaatactactatcgttccataagctctattcgtacaattactggaacggaattggataaaaaatattaaaatcacaagtcaaaacttaggatggaattgcattgctaagaattactgtataagatctaaaactggatgccatacagctatttaaagatgaagctgtagcgagaggaaggctgactgaagaggatgtcagtgtgccggatgattttttagttagaactgcaatgctggtgttttataaaaatcctgaaaaatgggtaacaggatcgtatataaagattggatattttggcggttcggattcttttttacggtatcagaatgaagatacacggtccgttgatggaacaggtagaaagaaccgttgaactggtctatataaagtatataaaatctttgattatgtatgatggtatataaagagtagaacagtatataattcattaggatgtgttcagggatattcttctgaatgctatcgttcataaggattatagcagctgtaacccgattcagatcagtgtgtatgaagataaagtggatatagggaatgatggggaaatgccggctaatttaaattctacataaaaattattcgaaaagcatttattgaagccgtttaactctaaattaggcacctttttattagtggaatgattgaagcgtgtggaagaggtagaggtttttctaaaataaaagaggcttgtacgcaatataatgctcctttgcctgaatatgatatcaataaagaaggtattatggtttttctaatagaaatttttttataaggtattatttagaagaaatgctgatgagtgaaaattaaagatgaccatgccggataagccatccagtaaaaacaaaatattattctttataaaaacgtcctatgcattgtcctgtacatgctatccaagatagtgtacaggataataaatagcccaattactggttatttaaagtgccaaataaacaaaatggcactttaattggcaattcgaatgactctttagaataaaatattgactataatcaacgaaaatcctaagctgaaataggcctaattagcggttttagcgggtagctctgaatgttcttcgaaacgactgataagttaatgatggaaactggaaatattctttgctggaaaatactcatgctgaaaagaattctaaaaaaacagtacctatcggaattgagaacgatctctttcggtgtatcaaagttgtgttgagtagtattacggtattatttggtacggtacaaatcggggcgaatggagtggtacagagcttttgttctttggctgccctcatggagatggctatggaataggcatttattactgtaatcggacagtatataagggcaggggatcgtgaggttgcagattattacttctgtaagctgtttcatattaccgtttttacttttgttatctggaatgcggctattcttgcggcagcttactgctatacttagtattatgcactctccggagaagtgaagcagctgattttcatgcttgtgctgattcacaatgtcttcaattcttttctttttgctcttagccattattcttgggatatggatgaagctgggagttataagtattacacttgccatgtgctatggattgggcatacgtgcactctgctttatcctgcggtttaaatctaaatccggaaaatggaagagtttatgagttatctgattatagggggagctattaaaaaagaagaccgggattttgtgcaggcgaaacagcctcggtaatacccggggaagagagaagagagaaagagaacctaaggggggcttgacaaaagaaaaagaacagcgtttaatgatagataatatttactggatttacataagtaaatgaaagagatgtcattaaggagcggtaacatgaaggggaaaaaaggtataattattgcggcagtcctgttaattctggtatgtgtgggagcgggagcgttgtatttgaggttccggccttccgcaaatgtaggaagcaagaatataacggtgacagtcgttcatgccgacagtacggaaaaagaattccggtatcagacggatgccgaatacctgggaaaggttctggaggatgagcagcttgtggaaggggatcagggacagtatggtctgttcattaccgttgcggacggggaacaggcggacgattccaaacagcagtggtggtgcttgaccaagggcggggagatggtgaacacctccgcggaccagacgcccattgcggacggggatcgctatgaactcactctgaaggaaggctattgatggcgggccttaaagtgaaggagacagcgctcctggctttgttaagcgctattttactcattgggcagatagcgctggggtttcttcccaacattgaagtcgttactctgcttatcatggtgtacagtattgtctttcggaaaaaggtcttttttattatatatgtttttgttttggcggaaggactggtatacggcttcgggatctggtggttcaactatctgtatgtgtggagtatacaggcggttatcaatcttcttttcagaaagcagaagtctgtggttttctggagtattctgtccggcttttatggaattaccttcggcgctctctgttcgcttccctattttgctatagggggaccgtcagccgcgtttgcctactgggtatccggcctggcttatgatatcccccattgtatcggaaatgtggccttgtgccttgtgctgttcaggccccttgtatatatactgcggaaaagctgcagggaaatcaatgtctgtgtggagtgatttccccgcagcttttctttcccgcagattcttagcaaaacattaacatgccaaacagcatcggcattttttcagtaaaaccggggatatatgcgcctgcggggatccaattccttcccaaatggctgtgggcgcatataaaaagttgtgagatattgctctatccatccgtgcctttttgtactataattacaccccgggtatcagaaattttatttctgacccggttttcctatttattttagaagtgtaatagaagtacgcatgaggaggaaggtaggatatgacagcagcacaaatagcagcagtagttattttcttagcaatgttcggattgattgtgtcggagaaaattgagcggcatctcgtttccctggggtgtgggcttctgatgattgttctggttttcgggttgagcatgcatagcatgacggccatctggaacacgcttgctctgaaggatttttttgcggcaggcttctggtatcaggcgggggaggcttccgagtcgtcctcagggattaactgggcgacgatcctgtttattgcaggaatgatgctcatggtggaaggaatggggcgcgccgggtttttccggtggctttgcctgcggattgcaaaagcggtgaagtacaggacgattccgcttttcatcactttcatggtgatgtccagcatcctggctatgtttattgacagtattacagttattttgtttttggcggcggcaacagtggaattggcccgtctgctgaaattcaatccggttcccatgattatttccgagattttctgtgccaaccttggcgggtcggctacgatgtgcggtgacccgccgaacattattatagggacgtcactgggttattctttcgggaatttcatcaggaatacaggaattattgcactgatagctctttttttcaccatcgtctatttttacttctgcttccgtaaggagctgcagcaaagcgcctcgggaaggggagcggtatcttatcccaatcccagggatgcgatagaaaataagaaggattttatcatcagctgtattatttttgcctgtgcggtagtgcttttgatcactcatgcccagactggtctgacagttgctgccatcggagtgtttatcggcgcggtatctttgataacggcaggcagggaggcggtaatcctgctgaaaaaggtggattataaaaccctgctgttctttatcggcctgtttatcgtggtcggaggactggaacagacgggaatcctggagctgatagccggttttattgcgaagataagcggcagcaatgccatgctgatgatcgccatcgtactgtggatttccgctattgccagcgcttttgtggataatatcccttttgcggcgacgatggtcccggtcatcaaaagcctggcggcagcctccggagtggatctttcggtactggcctggacgcttgccatgggaaccgatatcggcggcagcgccacccccatcggtgcgtccgccaatgtcgtgggtatttctgtcgcagcgaaggaaggccacatgatcggctggggaaagtattgtaagtatgcggcgccggcgacgattctggtggtgctgatatccatgatcagtatttatatccggtatttttaggagaaaggggcttttatggacagacaactgattatttctgtgggccgcgagttcggcagcggcggtcatgtgatcgcggaggctctggcggagaggttccatctggcgctttatgacagcaaccttttggaacatattgcacaggaaaaaaacatcgatcacggagaactgaaaaaatttgatgagaagccgaagaacaagcttctttcccgtacggtgagagggtattccagttcggcccaggagaatcttgccaacatgcagtttgagtatttgagaaaaaaggcggctgacggggaatcctttgttgttgtgggccgctgtgcggaaacaaagctgaaggactttccgggcctcatttccttttttatcctgggagaccgggagaaaaaggcggaacgagtgatgcaggtgtatggtgtttcgaaggaagaggccatacatatgatggagagggaggactgggagcggaaaacctaccataattattactgcaaaggaaaatggggggattccaggaattatgatttttccatcaacagcagcaggcttggaatagaaggtacggcagatattctggaaggatatgtcaaaacacttgccaatgtgtgtatacatgctaaaataaaagagaaggtatgaaaatttattaagctgggggaagtgttatgggaaaacagttaattatttctgtaggacgagaattcggcagcggagggcatgtgattgcggaggagcttgccaggaggtttggacttgtgctgtatgataataacctgctggagcagatcgccgaagaaaaagaaattcctcacgacggactgaaaaaatatgacgaaaagcctaaaagcaggcttttttccagaacggtccggggatattctaattccgtgcaggagaatctggcgaatatgcagtttgattacctgaaaaagaaggcagctgacggggaatcctttgttgttgtgggacgttgttcagagacgatactgaagggaacgcaagggctggtgacggtatttgtcctgggagatccggatgtaaaggcggaacgaatccagaaggtatatggtgtatcggaggaagaagccagacggatgatgaaacgggaggactggaacaggaaatcctaccacaattattactgtaagggtaaatggggagattccaggaattatgatttttctatcaacagcagtaagctgggaatagaaaagacagtggatattctggaaacctgtataagggcgcgtatgtaaccggatgcaagagtaagcaaaggaaaaggagaagtgacatggcattttattatgaggaaccatccagaacgttcagtgaatatcttttgatcccggggtattcttcggcaaagtgtatcccgtcggaagtgagtctgaaaacgcctcttgttaagtacagaaggggtgaagaaccttctctgtccattaacattcccatggtatctgctattatgcagtctgtttccgatgacaggcttgcggtcgccctggcacaggagggcggcctgtcttttatctatggctcccagcccattgaaaagcaggcggaaatggtgaaaaaggtaaaacgctatcgtgccggttttgtggtgagtgactccaatgtatcgccggaaatgacgctggcggatgtcctgcgcctgacggagcggacaggccattccaccattgcggttacggaggatggcggaccgaacggaaagcttctgggcattgtcaccaataaggattaccgcgtgagccgtatgagcccggagtgtaaggttaaggattttatgaccaaattccaggatctggtctatgcccacgaggagacaaccttaaaggaagccaatgatattatctgggagcataaaattaactgcctgccgctggtaaataaggatcaggaactggtttaccttgttttccggaaagattatgatacccataaaaataatgagcacgaactgatcgacacatccaagcgctatatgaccggagccggcattaacacaagagactacgcggaaagggttcccgctttgctggaagcgggtgcggatgtcctttgtattgacagttcggaaggcttttcggagtggcagaaaatcacgatcgactacataaggaataattatggtgataaagtaaaggtaggagccggaaatgtggtggacggagagggcttccgttttctggcagaggccggggctgattttgtaaaggtaggaatcggcggaggcgctatctgtattacccgggagcagaagggcatcggaagaggacaggccacggcgctgatcgatgtggcgaaggccagagatgcttattatgaagagacagggatttatgttcctatctgctctgacggaggaatcgtacacgattatcatgtgacgctggctctggccatgggagccgactttatcatgctcggccggtattttgccagatttgacgaaagccctaccaaaaaggtgaatatcaatggaagttatatgaaggaatactggggagaaggaagcgccagggcaagaaactggcagcgttatgacatgggcggagaaagcaagctctcctttgaagaaggtgtggattcccttgtcccttatgccggtaccctgaaggataatgtgaatctcacgttaagcaaggtgcgctccacgatgtgcaactgcggcgcgctcactatttcagaactgcagaaaaaagcaaagattacactggtttcctccacaagtattgtggaaggcggagcccatgatgtaatgctgcgggatcaaagataagtaagatagagtcttttttacgcgaaacaggcagagaaaaagcttccggcatcgttcggtacctttcaggtacggacatgccggaagcttatattttgctgtaaaaataggagtgagggcttagtcagttttcagcttcagccagatttccatactggcggtctgcgccgcatggctcgcatatcgttccgcacagaagggttctgtcgtcagcttatggtttggaagccaggtattaaagagatattggtttgctttataaagggcgtccagaacaagggcatcaaagttttccgcttcaaaagagcagacaagatattctccctcaggaagcgtccacgattggaagccctccggtaccgtttctgtcaggacctttgctcctgcaaaatagttgaaatagccttcttcggtacagggataggaaacaccgatttcttcttcctccaaactgcccattgccgattctttttgctcatgaaagctgtcccagagagcgccaagcggatcaacgccggattctgtgcctaatccttccgtaaactggaccggtgtcttatttacaaaaccggcaaagaggatgggctcttccacctgttttcggttgagctccagaacaataccatccgtaataagcggcaccccttcatcaatcagcatataatgcagaagcagctccggctttgtcatatagttcattgtccggggactgcggcggtattcctccggtgtgattccgaaggtttctttaaaacagcgggtaaaatgttcatgggaagaaaagcccagatcaagggctgtgtctaaaatccgctgatccttgttaagcagaagttccgtggcctttgccatgcggcgcagcttgatgtattctcccacaggcttttttaccaggcggcggaagaggcgctggtaatagaagggagacagcgcggcgagccctgcaaggtattcggtactgatgtcctcgttcagatgttcttcgataaaatccagtgttagttgtatttgttcccaggcatgcatagtttgttacctccttttttcttaagataacatggaagggcagaacgacgcttgactgggaatgcccttctttcaggccgctttattcttcgcccatctgtgtacggtacatctgtgcgtagcgtccgttctgcgccatcagttcctcgtgagtccctctttctgcgatctgcccgttctccataagcagaatgagatccgaatcccggatcgtggaaagccggtgggcgatgatgaaggaggtcctgccctcggtgatggtgagcatcgctttgcggatccgctgttccgttaccgtatccacggagctggtggcctcatccaggatcaggataggcgcatcctggagtacggcccgggcgatggtcagaagctgcctttctccctggctcagggcagaaccgccctgggtgagcagggtgtcatatccctggggaagccgccgtataaaggaatccgcacctgccattttggcggcggcccgcactctttcctccggtacgtctctttttccgtagctgatattttcgcgcacgctcatacagaataacgccgtatcctgaagtacaacgccaaaggtttcccgcaggtcctgaagcctgtaattgcgaagatcctgtccgtccagcagaatactgccgccgtcaatatcataaaaacgggtcagcagattaataagcgtggtcttaccggctccggtagagcctgccacggcaaccctggtccccgcaggaacgtgaaagctcacgtccttcaggacgggatcctccggtttgtagccaaaggtcacatgggaaaattccacttcaccccggggcgacctgaggggcagggcttcttctttgtcggccggttccggttcctcttccagaatctcaaaaatacgttccgcaccggcaacagccgtctggaagttattgtatatgttggcaatatccacgaagggcctggaaaactgcctggaatacagcagaaagctggaaatcaaccctacattgatccttcctgcagccgccaggattccgctgattacggcgacaatgacaaaattcaggttattgatcacgttggtgagcggcatgagaaagcctgaccagatctgggcttttgttgcaacctggcacaattggtcgttgctttcctcaaactgccggatcatttccttttccctgccgaaggcttttaccatattcaggccggaaatgctttcttccacctggccgttgagcttcccgagtatctgctgctgggaagcgaacagctttctggtgtgcttcgtaatggtacgtgtgagaagaaaaataagccatacggacagaaaggcgatgcaggtaaggcccgggcttaaatatatcataatgcataatacacccagaatggtaaagccataggtcatgagttgtgtcagggaatcggaaatcgtagtgctgatattatccacatcattcgtgaggcggctcatcagttccccgtgctgcctgctgtcaaaaaaggcgagaggcagggctttcatcttatcaaacagcgtgcttcgtatatgcagaataatccgctgcccgatggaagccatgaaaaactgctgcagaaaccgtacaagccagtccgtgagatagagggcggccagaaacagcagaagctgtgaggcaggattgccggtatcgatggcagttacggtatttccgataagcagaggggagagtatggtggagacgctggcgatggctgaaagcagaagcagccagcccagtccgccgcgctgtccgctggtgagatcccacagcctgcgcagtgtccctttcatatctttgggctttacgaccggtttgccgcgctggccctttccgaaggtggaagggggcggtgttatatccttactcatgctgcacacctccaatctgcgatgcataaacagcctgataaacaggacagctttccagaagctccctgtgggttccgaagcccataacatggccgtcttccatacataggatccgatccgtacgcatgacggtggaaatccgctggctgataaggaggacagtcatctgtgcacactggcttcgcagcatattcaacacagccgcttccgtggtggcatccagggcgctggtacagtcgtccagaatgagaatacgggggtttttcagcagcgcacgagcaagggacaggcgctgtttttggcctccggacaaatttaccccgccctgtccaagagaggtttcatagccatccgggaagcttctgacaaaagaatccgcacaggccatttccgccgccctctgaagctcctccaacgaagcattttcttttccccagcgaaggttttccgcaatcgttcctgagaacagcagggctttctggggaacaacggcaatctgcgcccggagcttatccgggtcaagctgagtcacatcgataccgtctatcaggagagttccctccgatacatcgtagaaacgggggaccagattcaccagagtggatttgccggagccggtgggccctataatgccgatggtttccccgggattggctgtaaaagtcacatgctccagcgccggctccggggtgcctgcataagaaaaggatacatcacggaaggagactgcgccttcgccggagaaatctttgggggaagccgtattcttctgggccggttcctccgtaagaatttcacccacacgtcccgcagacgctgtggccctcaccgccgtattcagtatattggagaccattcccagggagaaaagcacctgggtcatataattgaccgatgccataagacggccgatctgcccgctgtcctggctgccggaaagccacaggagcacgacgatcccggcattgacggtcagattgatcagaggggaaaagactgcggaaacacgcatggcggagactcctgccccggcaaagtccgctgccgccgcctggaatttttcgccttcctgctcctgggcgcagaatgcctttaccacacgtatggaagaaagaaattcccggctgacttcattgagcctgtcaagcttgcgctgcagtttcccgaaacggggatagcctaatgccatgttggcggcgatcagcaaaaaagaaatgcataagataaatatcatcatgggtatctgtttcggtgtctgcaggatgatgagaagtattgcgccgagacaggtaatgggggccttcatcatgatacgcatgctgccgttgatgaagttctggatctgggttacgtcattggtaatccgtgtgatgatggaagagggctgcagcctgtcgatattctcaaaggaaagcgtctgtactttccggtagatatcgctgcgcatctcccggcttatctgctgagaagtacggctggcatagatattgcgcatgactgcccccagtgcccccaaggctgcgattcccagcataatagcgccgtacatcaggatcctgccgatgtcccggccctttacgccgtcgtccacaatgtaggacataaaggtgggctgcatcaagtccgccagtgtttccaaacttaaaaagaacagcgcggtggcaaacatgccgatatggcgccggatgtaagagaggattagtttcatgtgattgcctttctgatgcggcatccttgatgccccgccgcctgcggcggggtggttgactccggattgcacatccttgtatgtaagttctattttaaatacgattggcggaggatgtcaagaaacaggcggggaaaagaaaggcatatagtgaataaaaaagatgccacaggccgtcagacggtgctataatgtatgggaaatgttaaaaatatgcaagatatatgttatgcaaaggcaagaaagccattccgggggaggataagggctgttatgaaatcatcaaagaaaatagacatgacacaaggctccataatgaggcaggtgctgattttcgcattgcctatatgcgcggggaatgtgctgcagcagctatatggaaccgtcgatacgctggtaatcggcaatttctgcggttccgtatcccttgccgcggtggggacgagcagtcagcctgttgaaatgctgctgtgtattttcctgggcctgggaacaggtgtatcgattctggtatcccagttttccggaagcggcgatgggaaaagccagagggagattgtcgcaacggctatttcctttttatacatatgcgccattccgctggcggtgatcgggcagtttgcagggccgcttgtgctgaaaatcatgcaggtgccgcccgatacctgggaccttgccaattcgtatatccgcattatttttatcggaaccctgggaaatatgggttataatatgaatgcgggtattttgaggggagtcggtgacagcagggcatccctgcttttcctgctagtctcctgtgttgtgaatattgcgctggatctgctgtttgtggcagggctggggatggatgtggcgggagcggcgctggcaacaatgctcgccatgtattgctcctggctgttcagtgtggcttatatacgaaggcagtatccggagctgggctttaccctgcttcccaaacggctgaataaggcaatgctggcagctatagtaaaaatcggcctgcctctggggctgaacggttctatttattctgtgggacatattctgatgcagtccctgatcaatatgcagggctccgtgtttattgccgcctgtgcggtcagcggtaaggttaccgggattgccaatgtggcgataaactccctgtcctcagccgccaccaccttttccggccagaatctgggggcaaagaattatgtatacctgaaaaaaggagggctgcagatccctctgttttccgggcttatcacctgtatggcagggcttcttgtgacattcttcagcaggccccttttaagtctttttacgaaggacccggcagtgttggattttgcggtgcgttatatccgtattgtccttcccttcacctggacttttgccgtctttaacggtattatttcctttgtaaacggaatgggtgaggtgcgtttccccacgattgtcaatcttctgatgctttgggccgttcggatacctgtgggttatctgatcacctattttattgacggcggttatgttatggcctgtctgcccataagctttgcctttgggatgctgtgtatgctcagctatttcttctccgggcaatggaaaaaaatcaaggagcaggcggcctgccagcaggaagaaacagtatcctgaggcagaaccgccggagtattatctgtgttccgggacggcggtgtgataatccttcatgacattgtcgaaccatctgtcgaatacctgggacagggattctgtgatttcgggataatcaatggatacgtcatgtctttccagaggatcgtcctccaggttgtagaggcggggcggatgtggggcaggaatgcggcggtaagagtcgtcgaaggggtagagcgtatcaggaaccgtttcttcctgcttgatcctttcgtcgatctccaccacgtagggcggcacctgcatggcttcctcgacaggcggccagacgagcttccatttgccgcagcggacggcggcattgcatttggataccggtgtgaagcggttccactgccagtaataaggttcggagggcgaagaggagcccaggagaatttcatcaagtctgtttttgccatccagcgaaaccccatcaggaagctccaggcggcaggcggaaagcagggtgggaaaccagtcaactccgtggaaaaaggcatggcagcggctgtcgggagcgatatgaccgggccaccgaatgacggcgggaacgcggatccctccctcaaaggcctctcctttctgaccattcaggtaacaattatagcggtttgtgtcaccataaagctgagggccgttatcgctggcgaagattacgatggtgttatcggagagtccggtttcctccaggacatccagaagcttaccgattccttcatccatgcaggcgatcattccgtacagtgtcgccagagtgggattaaagcgtttccggaagggcgcggcatattcctccgggcattggaagggaaagtgcggcgcgttataggcggcatggaggaaaaagggctgctctctgttctcacggataaaacgaatggattcttccgttatgacatcggtcatataggtgccgtcagaggcttccaaaattccgttgcgatccagtttgtattggtaataatcactccagccgccgcggaacccgatgaaggtgtcaaagcccctgcggcagggatggtattcttttccaatcaggcctaaatgccatttcccgatcaggccggtacgatagccgtttgcacggtagacgtctgcgagtgtgacttcgcgcagtgccatacgatcgccgccgatggcttcgtaggtatctacggcgccggtgcggtgcggataacggccagtgagaagagccgccctggccggggcgcagacaggggaagcggcataacagtgcgacatggcgcagccctggcggacaagcctgtcaagattgggagtacgggcgctgccgtcactgaaaataccgaagtcgccgtaccccatatcatccgccagaatatagattacattgggatgctgattttgtttcatcattgaattcctcctggataaaaagcctgagataaaaaaatctggtaaaaaacataatattatgatattataacaaatagaatacgtcaagcattgatttcagaaattccagttactggctgcaggtacaaaggaacagtaagcactgcaggcagcaacaatataacatggataggagaaggcagaatgagagaaggacttttatatgaaaaggtttatatggaccttctgcgcagaatggaagacgggacatacaggaagggagacagactgcccacggaaaaggagctttctgattattatggagtgagccgcatcaccatgagaaaggcgctgtcccttctggtggagaatgagacggttgtcaggaaacccggcctgggaacctttgtccagaacccgcctgaagcagataagcctgctgttgataaacagaagaaggagtctggtgtttcctccgctgcatggccgcaggcttccgcttcggcggttttgagaaatggaaccggaagaaaaaggatcgcatgcattgcggaggacgcctcggatgcgtttggtatatcggctctccgtgcgattaccggatatgcggatcaggccggctatgatctgatactgaatctttccctgaattcacagagtctggaggcgcgggagattgaatttgtaaagagtgcgggggcggaggggcttatcattttccctgcgatgggaagctcctataataaagagctgctgcgggctgtggttgaggattatcctattgttacgattaaccgtgaactgagcggcattccggcatcctccgtgggaatcgatcatggcagggcggcatacgatctgattaggctgttttatgaaaaaggacaccgcaggataggtattctcggcgatgcgccggaggaaggaaccgggctggcagagcggtaccggggattcaaggcggcggcaaaacactatgactgtgaggaagaactggtattttttcatgaatggaaactgaagagggccgccgggaacggaaaagactggactcctcttatgaaaagagaggaggatcgtgcccgttatgaagaggaatatgagctctacagggaattccttcgggaatatccgtctctgacggggtgtatcggctgtaatttcggcaggggacagaaaatgagacagcttgcccgggaaaaaggaatagcggtaccaggcggtttgtctctggcctgtttcgatgacattggctatgaatgcggggatatttctcttacgcatgtataccagccggaagatcagattgccggcaaggcgctggaattactggaaaacaggataagcagtaaagcggccgggccggaaaacgtaattctggactatcagatacgggactgcgggactgtgggagaggtaaaatagcaaacgggaatatataatgaaaaagccgtcttcggatggcttttttatgtccttttttctttggaaacccggaaatgccgtcattaaatacatgtactgtttaaaaaagcaattgacattatacaaagtaaatgatattattataaaaacataataataatacaatataacaatatggcagggagggtacataacatatgaaaagaaaaggaacggcggaaggaagagggggaagcaggaagagaggcgggccggttaaattccggcgtatcattgccaactggcagctttatgtttttcttcttccggcattgatctattttattgttttctgctacggccccatgtacggggtgcagatagcctttaagaatttttcgccaagcaagggaattgccgggagcccgtgggcggggctggagcattttaaacgatttttcaatgcgtattatttctgggatctgatccgcaatacattgacgatcagtatctacagcctggcagtcaattttattctgccggttctgctggcgctgctgctgaacgaaatgaaaaaaggaaagctgaagagtgcggttcagacggcgacctatgctccatattttatttccgcagttgttttctgcggtatgattaccacttttttaagtccggccagcggtatcatcaataaaataatagaagcggcaggcggtacggccgttaatttccttaccacgccgaagctgttcccctccgtttatgtctgggctaatgcatggcaggctaccggctggggcagtatcatttacctggccacgctctccggagtggatgaacagcttcatgaagcggccatgatcgacggcgcaaaccgtctgcagcggattcttcatattaatattccccatcttctgccgaccatgattaccctccttattatgaatgcgggttccctgctgtccgtcggatatgagaagctgctgcttttgcagaatccgctgaatacggagacgtccgaagtcatttccacttatgtatatcaggcaggccttgtcaatgcccagtacagcttcgctacggcggtgggattgttcaactcggtgattaacctgattattcttatactggtgaatacgctgtcacgcagaatcagtgatacatcactttggtgagaaagggattaagatgaaaaagaaaaaaatatcgcgtttcgatgtcgttcttactgtattttcactgattgtgcttctgataacggtatatcccctgtattttgtagtgatcgcctccataagcgaacctcatttagtgagcacgggagccgtgttttttgtaccgaagagcattacatgggaaggctatcagaaagttttaaaggattcggaaatctggatcggttaccggaacaccattttttatacagtggcgggcacgcttctgaatctggggatcacactgcccgcggcatatgcgctttccaggaagcagctggcaggcagaaagctgtttatcatgctgatactgtttaccatgtttttctcaggcggcatgattcctacttacatattggtaaagggcctgcacttgacggataccctgtgggcgctgattcttccctgcgctgcttcagcctataatatcgtggtggcgcgcacgtattttgaaaattcgatcccgaaggagctggaggaagcggctacgatagacggctgctctaatttcaaggtatttttccggattgtactgccgctgtcggcgccgattgtggcggtaatgactttattttatgggatatcccattggaacagctattttgacggcatgatttacctgtcggaccgtaagcttttcccgctgcaggttattctgagggaaatcctttccgtggcacagacggcttcctcccagaccatgtcggcagaagacgccgttacgatggcggaacaggcaagaatagcagatttggtgaaatacgtaattatgattgtagctaccgcgccggtaatgctgatttatccctttgtgcagaagtattttgtaaaaggtgtaatgataggctccgtcaagggatgatttggtaaaaacagccggattccggcttgtaaattaaaaaggagattagaggtatgagaaagcaaaaatggttcaggacactcagtttggcgctggcggcgggaatgctgcttgccggctgtaaaagtgcggcggagcctgcacagggcggggcggaaacagaagcagcagaggtttccgaagattttaatgaaacaggatatccgatcgtcaatgaaaagatcaatgtcagtatgatgggatccaaggcggcgattcagggagcatgggaaggacttgtattttttaaggatatggaagagaaaacaaacatttccttcacctttgacacgcctgcttccgaggtttttgaggaaaagaaaaatctggctctggcggggggaagctacccggacgtgtttttcggagccaatctgactacggcccagcagatcaaatatggtatggaagaaggaattttaatcccgctggacgagttgattgaaaaatacggccccaatatcacccaaatgtttgaggagcatccggaggtaaaagcatccatcaccgcacctgacggacatatttatgcgctgcctaatttcaatcagggctccctggcgaagacgccgacctggtggtataacgccgaatggctggaggcgctgggcgttacggagctgccgaccacaacagaaggcttttatgaacttctgaagcgctttaaaacagaggatcccaacggaaatggggaagcggatgagatacccttcaccttcattgtcaatgcgggaaacatggattacacggatcccaatctctatatcctgcccgcatttggtgtgaacagtgccaggatttatgtggataacggcgtggtaaaatatggggctttggaagaaaatttcaaagaatatctgaagtatatgaaccggcttttcacggaaggcctgattgaccaggaatgggctacacaggatgacagcaccagaatcggcaaggcgaaaggaaacacggtaggtattgcggcacaggcgatcccccagaatctttatgacgtgacggatgcggaagaagcgaaggcatatcccctggcgccggcgcttagcagcgaattttccggcgggaaacagcgttatcttctttacagccagggaatcacacagggtgcgtttgccattacgaataaatgcacagcaccggaagccatgatccgctgggcagattatctgtatggagaagaaggttcgttttttattcattacggaaacgagggcgaactctgggaaatggcagaggatggaagatacgaacatattacacccgaaggcggcatgtccgtggaggaataccgcggcggtatcgtaactcctgactgcgggactaccactcccaagtgggtacgcccctccactgtctccaactgggtggatcccttccagagcgtacggattgagcaggtggacgagctggtgcttccttatgcggatgtggcgttcccatctacctatttcatgccggaacagcagaaccgtattgatgtgattgaagcggatctgaataaatatatggaagagatggaagcggcattttttgcgggtaccaaaaatatcgacagcgagtatgataattttaccgctaccttaaagaagatgaatgtggaagagctgattcgtatttaccaggaatcttacgataactggaaggcggcccaataaagatgcctttcggtccggggctgctttaccatatatagaaagaggataagggaatgttcttaacaaaggaaaaactatggcgccgtgtaaatgaactgggaagcaggcggtatgccgtcatagaatccctgtttccctttttctccatggaagacacaggcgggccggatgaggtccgcctgtcctttccggggaaaatcaggggagaacggaaacagagaatggattttttcacggggctggataaatatctctggctccagaaggagatacagctgccggaggcacagccgggcaggactcttgtgggactgtttgatttcggaaaaacaggaggaggccacaacagcggttttgaatctctgttatttgtggacggtgtaaaaagacagggggtggacagcaatcactgtgaggtggtattcgatgatctggcaggaaaccgtgcagagctcacttttctgttgtggagcggtctggagggcagtgatatttttcatgagaagcagtaccatcagctgagacgtgccgaactggcatggcttcataacgatgcaaatgagctgtattatcagggaagggccgtgctggaaacgctggatcagctggaggaaacatgtgaacttttccaggatctgctgcagctgttaaaccgtgcttttcttctgcttgactgggatacggacaggctttacgatacggttcccggtgcgctgcgtctgctgcaggatggactgggacggatggaaaaacagacacaggtaacggtgcactgtgtgggacatacgcatatcgatgtggcatggctgtggaggctgaagcataccagggaaaaagcggtgcgttctttttccacagcggtggaactgatggaggaatccggggatttccggttcctgcagtcacagccgcagttatacgaatgggtgaaaaaggatgccccggagctatatgaaaaaatcaaaaacaaggtgcgggaaggccaatgggagccggacggcggcatgtggctggaggcggactgcaatattccttccggggaatccctgaccagacagttcctgtatggctgccgtttcctgaaggaggaattcggaaaagcctgccgctttttgtggcttccggatgtgttcggctacagctgggcgctgccccagatattaaagctgtgcaatatcaaaacctttgcaacgactaaaataagttggaaccaatataacaggatgcctcacgacctttttttctggagggggatcgacggcagtgaaatcctcacctattttctgacaacgccgcgggaggggcaggatcccaaatccttcggcgcgacctataacggttacataaagggggagactgtgctgggaagctggaagcagtttcaggataaagcgctcagcaaggatgtcctgatgtcttatgggtacggtgacggcggcgggggcgtgacgagagacatgcttcaaagcggcagggcgctggaaaaggttccgggaatgcctcatgtaaaatatgatacggcaggcacattttttgataagctgcatgagaatgtaaaacaggcggaacagaacggagaatatgtccatacctgggacggggagctgtatctggaactgcaccgcggcacctatacagcgcaggcggaaaacaaaaaatggaacaggaagctggaacaggctctgatgcggaccgagtggctctgcgtgctggccggatgcggcggacaggctgccgatgacctgaaaaatatatggaaaaccgtcctgaggaaccagtttcatgacatcattcccggctcttccatccatgaggtgtatgaggattccatacgggaatatcagtccgccgacagttgcttaaaactgctgacggataagctggagaaaaaactgatgctgccggaagaggagagctggactctgtgcaatgcaggaagctttgccagggatacactggtttgtcttcctgcagacgggaaattacggccggcggatgaaacagggaggcttcttcctgtgcagagctgtccggatgggctgctggtgcagatatgtgcggagcctctttccatgaaaacactgtcatttgctgagggagaaagtagaaacggcgggcagcaggagaacgtttttctttgggattcccaaaagcggattcttgaaacgcccatatacacggctgtgtggcaggcggacggtaccctgggttctttatttgataaaagatgctgccgccaggtgctggacgggccggggaacagccttaccgtttatgaagataaggccgtggtgtttgatgcctgggatattgatattttttacagagagaaaaaggaggacttccttttggtagaagggccagtactaaaagaagaggggccgcttcgtacaatcctttctttccaatattcctaccgaaattcccggatttcccaggatgtgattttttacagcttttccggtaggattgattttcagacatgcgtggactggagggaggatcaccggctgctgaaaacagctttttccgtaaatgtgcgcagtacacaggccgcctatgatattcagtatggatatctgaaccgtcccacacattggaataccagctgggatcaggcgaggttcgaggtggtcgggcataagtgggccgacctgtccgaaccggattacggcattgccctcttgaatgactgtaaatatggatacagcgtcaaagataaccggatagaattgtctttgctgaagagctccaagaacccggatgagacagcggatatggggattcatgaatttacctattccctgctgccgcatcaggcggcgcttgcggacagcgaagtgttcgcacaggcggaagacctgaatcagccgttgtatcctatgaaaggccggcccggagccgcctgcgtcaggatgttctgttgggaagcggataatgtgattgtggatgcggtgaaacccgcggaggatggcaatgggatcatcctgcgggttcatgaatgccgcgggaaaagggtatctttcctcttgcagtcggaatgggggctggcggattatcaggaatgtaatttgctggaagagcctctgaaggatgtacagccgtacatggatgggataccggtcgaactgcggccttttgaaattaagacatggcggatacatgcagtatactgattaggcagaaacgatgagagcccgaaatgtacaacgcacgaaaatagtaacagaaaaaataaacaatgcggacagccggttatccggctgtctttttgatgcatcgctttccggctgagctatatatatttacctttttatcgcatatctactgcaaacgtgcctcgaatgaaatgaaataatctattagtgtaaaacaggcaagagatgtagtataatctatccaaggaaaatcacaggaaacacgaagaaaatttatctatgatgaggtgacaatatggaaatagaaatcaaaaaattaaccccggaacttgcagaagattatgttcacttttttgacgtaacaccccataactttaatgaatgcatatgctattgcgttacctggcgcagtgacaattcttatgcaggtgatggcgatcattggtttcctacacaggaggagagaagagagcgcgcccttcagtttgtcaaatccggcagcttacaggggtatcttgcctattgcggggacgagattgtgggatggtgcaacaccaacgcagattgccggttctgtttaaactatctgcgttcatactggccgatagaagaatatagtgcggatatcaaagtgaaatccatattttgttttgtagttgcgccgaaggtgcagagaatgggtgtggccacgaagctgctggagcgtgtttgtcaggatgcagcggcggatggttttgattttgcagaggcttatgtcaacaaggagttcactgaaacagatcgtgaattcagaggtccgctgacgatgtatgaaaaatgcggattcagcagatatggggaacgtgaaggcagagtagttatgcgaaaggcactgaagtaacggccggagccattacggagtatgagcataatcaatggctcagtattcatcactcagcagaaaatcggcaatatgcatggttttaatcccttcatagtttccatcagcaaaggcatctgtgcgaagaacatatttggggtaattatcccggatatcaagaagacggccatattcccgctgttctgtttcaggagaagcgatttcccgggtcacctggatatacagcttgttttcctgtttaacagcgatgaagtctatctccatattttccagtttccctacataaacatcataccccctgcgccgtaattcaagatatatgagattttcaagcatagcggccgtactgtcgggagtatagcctaatacactataccggaaagccggatccgcaagataaaatttctcctgtgtttttaatatttcttttccctgtacatcatatctggaacatcggtggatgatataagcattttccagctttgtcagataactgtaaaccgtctcgttatcaatggttcgattttcacttttcaggtatttggatatagttgatgctgaaaatgttctgcctgtattgtcaaaaacaaagcggacaatgcgttccaactggtctgcctttcgaatagtattccgtcttacgatatctgtaaagattgttgaatgataaatatctctcacaattgtataagcatcatcaaaagaatatttctgaagatgaagtgcggggaaacaacccagcctcagataattggcaagctccatatggatatctgacagttctgtatagactttgcggaaagtcagatattcggaaaaggaaagcgggtaaatgcgaaatgatacatatcgcccagtgaggtacgtggaaatttccgaagacatcatgcgtgaattagaaccggtaacataaatatctacatcataatcggtcataagtgaattaaccaccatttcccatgactggacttcctggatttcatccagaaatatataggtttttttatcttcagaaaggcggggcttcaattcggtatataatgctttgcttgttttaagatcctcatgctccaaagaatcaaaattataatacagaatacgttgtttttctataccgcggttttgcaattcattcattaccattttcataattgtagattttccgcagcggcgtacgccggttaagatttttacaaagggtgtatccagataagacaggattttgtttgtataaagcggccgttctatcattacatcacctccatgtatatagtataccgcaatacaagagaaaataaaatagtttttatggttataaccgcaaaaatatgagactattttgcctccgcttgattaaagtacctgacaatattatcaattccattcagtgcatccggatctttcgcagcaggcctgttatttgtattgtggctgtagaccagagggaatatatcatgacaattcatatgatgtaaaagggtacaggcagtttcataggctttgcccatgtgtccgtctcctccgccgattaatataacagtccccttttttgacttgggaacaggctcttccctcctgaaaaatcgggcactgtaataggtttgcagacggctgcccaaatccaaaagctttcctgtaagttccgaaaaataaatgggagacgccagtaaaatattatcgcattcctgtaattctttgtaacagctgctgtagggtaatggaagcagttaagtctgcatccggagcgacgctggcattggcagcatatgcggcgaatcctttatttgattctaaatgttatcggtttgaaagtcaaacttcctgtccgcagattcctatggctattgacggaaaaagatgttattctggcaatatagaaagcaaaaaaggaggaggcgtaaactatgggggataaaattcacgttaaggatctgcataccagagatgtatgtattgttccctgggaaaaggaacagaagtattttctctatgattgttttgaacgtccgggacagaaggggcgggccgtaaacgtgagggaaagcagcgatcttgtctggtggtcggaaagctatcctgtgtttgaaccggatgaaaacttttgggggccgttggatttctgggctccggagtgccattactggcggggaaagtactatatggtaagttccttccgggcgcccggaggctacagagggtgtcagttcctggaggcagaaacgccgagggggccgttccttcctaaaaagaataagccggcaactccggaaaactggcattgtctggatggaaccttatacgaagacagacagggtaagccctggatggcattctgccatgaatggctgcaggttcaggatggacagatttgcgccatccgtatggaagaggatctgtcggattccatcggggagcctgtcatcctgttccgggcatcggaagcgccctggcgttttacggatgacagagatttatggaagctgacagagccgcagcccaagatgggctgggcaagggtgactgatggcccttatctttaccgggccaaaaacggggagctgctcatgctctggagcagtttttccaatacagcctatacatgcggttatgcccgttctctgtcgggagagatcacagggccgtggaaacaggagccggaaccactgttcagccaggacggcggacattccatggtgtttaccaggtttgacggaacgctgatgatgtgtctgcatacccccaaccggccgggaaaagagcggatgctcctgtttgaaatggaagacagcttcggaaaactgcatatccgcaatgaaatcacaggcaactggatgtataacaaatacagggaagacggcagtgacataggaccttatgaggacaaagagtagaaaaggtatcgcttaattcaggaaaccggatcgggatcgtcctccccgcaggtacgaagagcctgaaaatagttagaggcaaaagaagcgcctgcaaggaaaagggcggtccccagaccggtatagaatacggcgataaataaatccggacaaaggccggaaacacgcagaccgataccgaaggtcatcataaaagccatgatgcaaaatgatttgatgtcaaaaaatttaaggaagaactgtttttcctcctgataattaagaatacggaaggtatgttttctgacaagcttgtcaaataccaggaaccagaatgcggcaaatatcacacatgacaggaacagattcaacagggtgacattgccccgataggaaaggattcctattctcagaatgttaaatccggcaacagcccagataatgcctgccagcagcagtaaatgttttttgttgattttcaacggaacatcctccataaaagttttaataatatgaacgatgttcattgtacgcctgtaattatcttctgtcaatctcttcctttttctttttcacggcggaaaagggacagatttcatagcaggttccgcaatgacggcaggcatccgtaatgtgatacctcctctaaaactgttttcaggcttgctgacacctgcctgcgtgtttataatagttccataggtgtcagaagtaaagaaggtagattttagtaacatggtatcttttggatactgaaaaatagaaagtcagtccggatgctgcataagacagacccgcgtggtgagagaggggataaagataagatgaaggataagtacaggaacctgccgacaattctgttttggttatatattgccgcagtactgcgcatcaccgtatttcgtccggggttccttcctgtggagctgctgaaaaacggaagcataaacctcactttatttcagggctatgtcccgctgcttaaaaagggtgactggttccgtttcctttatttattcgtggggaatatcatctggtttgttcccttcggaatgtacctggagcataaatttcgggagaaaaggttatggaagactgtcctggccggtttccttttttccctgactatcgagagcctgcagtatcttttcggcacaggctattcggaattggatgatttgatactgaatactgccggtgtatttgcaggagcggtctttgtaaaggggataaaacggcatgctgttcgcggaggagggaaaccttacgttaatgcggaaggtaaagactcataaattcaggtatcggcagacttatctgcgcagggcagcagaaggcgtattgccagcatgccttcttccagccgcgcgtccagccggccgcccatctgttcggccagcagctttgctaccgacatgcccagtccgctgccctgggcatgtctggaagcatccttccggtagaaacgatggaaaatctgttccgcatctttttccgtaaatccttccgcggggttgcgaaaagtgagtaccgcccgacctgcaatgcattccagggaaacggaggcttccttttgtccgtatttgaggcagttggaggtcaggttgtggaagatacgcagcagtccgttttcatcagcagatacccacaggggttcatccgtaagccgcagggtaagtttcagccctgccttttcaaattccccgtagaaggccaggatatgctccttaaacagatgggtgatatccagcctttcctgcttcaggggaagctcccggttttccaggcggctgtactcatatagctgggcaatcagctggttcagatatgcggtgcgtctttgtaccacgtccaggttttctttttgttccgggcttaattcttcttctccaatcaattccagatatccggaaatactcgtgagaggagtccgcagatcatgggaaatattagtgatttcggcaaggatttcctgttccctcatgctttccatgcggcttttggcaaaggaggcatcgatgtaccggttgatttctccggcaagctcctgcaggtgtgtgtcgggagattccgcagtcagatgccgcagggaaattccttcgtcattgatttccttcagatccctgcggataagcagaagaccgcggcgcagggaaaagaggcgcatggccagcgccagaacaataaggaacaaaagaatacataatattttacagaccatagcactgcctcttttccatgtttttttattaccgtatctcccgtttcttcagccagaaaatcccagcacagagaaagatcagggctccgcccaagccggagagatagcagcgcagcattcttatgggagtatcccagtaaaaatgaatgcctgcattgtcgaaggaaagaccaatcatgcttgcgggacaccattcggcggcttctgaaaaaatcgggtatttcattcccaggaaacggaaaagatagggaaggatatacacaataaataatatcggaagaatgcctgatatgctgtttccgatgttgaaaataaagcagaagccgatggagagcatgaaaacacacagggggtagcctccgatcagggcgtgagccagataataccattccccttcattgctgtgttccagaaacagccaggataaacatactaaaacagccggcaaaatcagatagacgagagtgcatatcagcagctgcaccaggaatttacccaggtaaatactgctgcggggaatgccgaaggctacgctgtttttaaggggagactgtctgttgcgggagttattctccataaagccggcaaaaaccagtgtgagggggaaaataccggacatggaggtaaaaatgccgttgaatgcaaaataggtattggcataagcgaacccaggccgccttccgaaaaaggcaagtactgcgaccatcagaataataagccccaggcataccagtattgtgttctgcagtccccggttgttccgctgccggtaccattcacttttcatataattaaacatctgcattccctcccatcagattcatatagtaatcctccagctctatattcagtgcactgatggcatgcaggccgattccatgaagaatggcggccctgctgatttcttccttccgttcaggaggggcgtagatattaaaatgtccgtccggtaatattttgtattctgtaatccccagctccttctccaggatgaccgccatctgtcccgcatcgtcaacctcaagtatgatataggtgccgcacttgtccttcagttcctttgcggatatctgttccagcattttcccgtgggacagaaaaccgtattgtgtagccagattttccagctccgagaggatatggcttgagatcagaagggtaatgccgttttcctggttcagccgtagaaggatattgcggatttccaggatcccttccggatccaggccgttgatgggttcgtccagaaccagaaattcaggggcggcgagcatcgcaagggcaaggccaagacgctgcttcattcccatggaaaaattccggtatttctttttccccgtatttccaagccccaccatatccagcagccgggatatggtttccttttccggtatcccgaactggagacggtaatattccagattctgccgggccgaaagatcaccgtaaaagccgggttcttctatcagggttccgatccggcggcggacgcgctgttcttttttctcggggattttcccgaagagccgcatttctccccgatcgatccgagtctgcccggatatcagccgcatcagcgtcgatttgccggcaccgttgctgcccaccagcccgtagatggagcctctggggatttccatcgttatatcctgcagtacagggacattcctgtatcttttttccacctgattcattgtcagtactgattcactcatggaaaattctcctttcttgttgtttccttcaggatagccttaattgttttagcagtcctatggaaagtataaagaaagtttaaagatttattttgtagccgatgccccacacggtctgtatatattcttcgtcggtaagggccgccagctttttgcggatattgctgatgtggacgctgacggcgttgtcttccccgtaaaaatcgctgttccatacggactggtacaggttctccctggaaaataccttttggggattggccattaacagctgaaggagaaggaattcatgggtggtgagggggatttcttcccctctgagcagtaccctgtggttctccggatataattccagctcccggcaggtcagcttctgaggggaggaagcatccgcctgtacggcggaatagtcgccggccctgcgaagctgtgcctggattcttgccagaagctcctgtttttcaaagggtttggtgatgtaatcgtcagcacctgatcccagaacattgaccttatcggaaagcccggctttggcagtcagggctatgacaggcatccgcagtgtcttacggatttccgtaagaagttcttcgccggacagccccgggagcattaagtccagcagaacaagatcataggtgttcagcttaagcagcagccggccttctgtgccggaaaaagcggtttccgcttcgtagcctgcccgttccagtattttctttaagagagtattgatatcagcgtcatcttctatgactaatattttatttttcataaatggctccttacagggaaaacggcattttgtttttcgggttatcaggtacagcctgcattggaaatcttgtctggtatacctgcctgtagcttaacagatagagtgggaaaaggtcaatgccgctttttgaacagatgcaatacaacaaattagagtatgtattgcgacctgttcgggaaaactatgcattgctatgattgtcatagaaaatgcgaggtgatacctatggagaaagaggataatcagccggatgagaagcagagaaagaaaaaagaagagaagatgcttaatctggaaataggcggaaggcttaaggaattccggaaaaatggaaaatatacccaggagcagtttgcggaggttttggaagtgaatgtggagcattaccgtaaattggaaaatgggaaatatgccttaagtcttaagaaactggagactttatccaaaaaatataatctcaatctggactatctgataaccggtacgaaggacagccgtgagtttaatgtggaggcttatcttgccaactgtgaccgtgatcagagaaatgattttattgagcgagtccttatatatatgaagaatctgatgctgaattcctgaagaggttccgggtgcggatagaataaagggcagcagaaaggccaggcttattcttatgggatatccggacttttctgctgctgttttttatgattttataggggcggaaatatccctgcgtaagccagggacacttgacaagtatccgaactcggactagaatgaatatattcttataaatccaaggagggttttccgatgaagcaggagagtaaaaaagtatttggattgatgaatcagcaatttaaggagctgaccgcaatctatcaccgggctgcctgtcagtacggcatttccgataatgagttttgggtgttatatgcgcttttcgtttttgaagaggaacaatcacaacagagtatcagtgaaatgtggtcgcttcccaaacagaccgttaattctgttgtatcgggcatgatcaaaaaagggcatgtttatctggaaacaataccggggacacggaataagaaggtgatccgtctgacagaagaggggaagagatttggggaaagtgttatttttcctatatacgatgcggagcagcgtgcagtcgataatatgacttcgcaggaacagcagctttgtacggagctgttggcaaaatacatttcatttttagataaggaaatctgataaacagcctgtcctttttggggcctgtatactgctgtacatgtaatatctgtacagcagcatacaggtcttttttcgtcctgactgtccgatgcttgacaagtatccgaaatcggactataatataaacatccgaaatcggactcttttgcagaacagaaaagactgataaaaaaggaagggacttcgcattgatgaatgaaaaaaacaggcagactttatttttaatcgtattcggcattctcttgtttgccgtcgttatgaatttttccgttgtactgacatttctcaggagaattgcagacttgcttttccctatattgttagggctgctgtttgcttttgtcctgaatgtacccatgactggctttgaaaagcttttgacccgtctgtcggacagggcaaagcatgaaccttcaatcaggcttttacatggaatgagccttatgctgacattactgtgcattgcgtttgtgatcttccttgcctttgccctggtgctgccggagctggctgaatctgcaaaaagcgtatggccgcttctgaaagagcaatggccggtatggatggaacatctgaaagcctgccggattgatctttccgcaatttcaggctgggtggcgaagctgaatatgaaaacactggcaggaggcgctgacaatgtcatggactccgcgatgcaggcagcggcttcaaccgtatccggcgttgccaataccgtatttggattggtgatatccatttatatccttattagtaagagtacgctgggaccgcaggtcaggaagctgatcggcgcgaacctgaaaaaaagcaccgcagaacgtatctgttccatcgcttcccttatccgggaaacctatagcaaatttctgtcgggacagtgtgtggaggcaattttgctgggctgtctgatctttcttgcgttcagtctgttccggcttccttatgccggactgaccggattcctgaccagtctgtttgccttcgtaccctatgtcggggcttttgcctcctgctttataggggctttgctgacattgcttgcagcgccgtctaaggttcttctttgtgtacttgtttatttggcggttcagtttattgagaatcaatttatttatcctcatgtggtgggaaactcggtcggtctgtccccgctgtggacactgattgccgctctgctgggaggcaaaatgttcggccttcccggcattatcttttttatcccgctggtggctgtcatttattcgctggttcgtgagaataccaatcggaagctgaaaagacaggccgccgcaggcggggctgccggaataaaaggggtatcggatcagaaagggtgattttatgaaaatagcattattcagcgaaacgtatctaccccaaatcaacggggttgcaacacatataaaaactttgaaggaaggtctggaaacgcttggacacagggttctggtagttacggcagacccaaaggcagccggacattacgtggaacatggtatactccattgtcctgcgacagaactgaaagatttgtacggttatggtatggcggcttcctatagcccggagcgtatgcgctttattaaggagttttcccccgatattgcccatgtccatacggaattcggcatcgggtccaccggtctggagaccgcaagggaactgagaatccccttgatttatacactgcataccatgtgggatgagtatctgcattacattgcttcaccgactctttttcctgcggtccgcaggcttgtttatgcctatatacggtatttcgcaaaacaggcagacgctattatcgggccatcggaaaaagtacagaagttcctggacacttgcggtgcaggcagaaaagtcaatatgatagccaatgcggtggaattcgacaggttttccccggaacaggcagaccgtacggttacggcaagactccgatgtgtctatgggcttagtcctgataatctggttatctgtttctgcggacggctggcacgggagaaaagcgtggatgtattgattgattattttgctgtctgccaaagggcggatgaacggattcgattgatgattatcggggacggccctgaactggcggagcttaaaagccgggtcaggctgctggggcttacagatgccgtgatattcacaggagcagtccctcatgattctgtcagggaggtatatgcctgctgcgacctgtatgccacggcctcccgttcggaggtcaattccatatccatgctggaagctatggctatggggctgcctgtcctgtatataaaggatgaggctaatgcaggacaggtgacggacggggtaaacgggtatattttccgtaatgcggaggagctgtgtgctgccgtttttcattatcgggatcgcagtgaggcggaaaaacaacagctgcgttcctccacaaggctatccgtatgctgcgccaatcagatcaatatggcgggacatgtggaggctgtctatataagccagataaagaggaaagcggcaataaggaaagagattggaaaaggaggcggttcggatggcaatgcttgatattttgctcctgtttctcgtgggaaatgtacttggttttgtactggaaacattatactgttatctgcttacgggaaaatacgtgagccgccgcggggtagtttacggcccctttaaccagatatatggatttggagccgttttgatgactttgcttctgaagtcccttgcagagaaaagcctgccggcgctatttatcggaagtgcggttctgggtgggatttttgaaatcggatgcagtctttttcaggaaaaagcctatggaacgatgtcctgggaatattccggacagcgcttcgcctttttcggcgggcggacaagcctgaaatttatgtttttctggggaatcctgggtactgcttatatcggcgtgctccacccgatcctgtttgcattcttcggcaggataccgttatccgtcaaggcaccggtggtactcgcattaactctttttcttatttatgatctctggctttcctatgtggcagtcggaagatggagaaagcggctgtgcggtacgcccggatccggacggctggatgcatggctggataagaaatttacagatgaacggatgaaaaagctctatccggccatgcgtgccgctgaccgcggaaacagtgcttccggcagcagaaaaaagacgatgaggaaaatgtggggcggataaaaacagcgcggatacgtcagctccctgctatttatccagagtcacacaggcgatccccagaatttccgacactttttccattatagatgcgttatgccccacactcatggcgaagtggtgggtgggcgcttcggcgaaccattcatccatataggaatccggatcctttttaaatttcaccggggtctgggtattgccgatagtcataatgggaccgtctgtggactgggcctcagttataatgaacttaagcctgccgtcaatggtctgggtgcaggccagattggtgatggggcctgtgcgcacctttgcctcgacggaaacgccggtgccctgtttgccgtggtaaagccccattccgcgcaggatgggtttccctttggcgatcgccagatggaaagggccgtcgtgtccgagcaggatggtgccgtcttcataatccaccgtcacgatttcacagaagctgccgcccgtgcctaaaatatcacatattttcatggcgaggcaggttttcagatccccctcaccggcgcagggtattccccgggcggtcagcagggaatggccgacgatgaagccgctctgcagtttttcatattctccgccgggagagccgtggtagtaataggtcagagcatccaggccgtattcccgtacaagcctttcctgggcagcagccacccgggcggaccagtcaagctgctcatccgttggcttttgagccagcgggtcagcggccttttcttcactgattaagaaaaattccaggatttcctgtttctttgccaggacttcttcctctgttacctgtgaaagctctctgtttaaatcacacatttccagtatttctatatgggctccggtctgtgcctgtatcatggtaaaatcgctgtacatatccaacattccgttatacgtatttcccaggaatccgaaccggcagccggataattccctttttactgcggcggccttcacccattcaccgatttccttccatgcctttatggcttccggacgtgaagccgtattttcctctgtgagggaaatgccgggcgtgtgatccaggccgagaagtccgttgatgatccggcaggcaatgccgctgcggtggaatgcattggacagctccgggacaggacaggcgccgcagtgagccagccattctccggtagtcgtcctgtcataggcaatccgcgcggcgggctgcaggttcagtatcacgacaggcgccctgcagatctgatggatgggaaggacggaggagctgttcacataggtgcctgaatgggcgaatatcagatccacgttatgggaattaaaatattccccgcattccctgcctgcctcttcgcagtcggccagtccatagaaaaagacctctccgcccagagccgttattttatccgagataaactgtccgtaatgaagcagtcgttcccgaagtccgggaaactgattccagtaagctttcagccccatggtgtagattccgatacggggttttttgggagctttccatttttccataagtaatcctttcctgaaaataatattattttgtaaaaagaaaatgaactttatattctgattataagctgataaaatagaagttacatccaagaaagttggctgaaaataatagaaaattggtatatgggttatcgtacacacccgccctgtgctccgcagcttctgccggcctgatttcctcccctgtggggctgtgtaccctgcgcaggcacgccagtgagtgcttgcactcgctttcgctctgctaaaaacgcagcggtactaagattgcagaggacgcaatctaaggaccggcgtttttacaaggcctttgcagggtacacagccccacaggggaggaaatccggccggcagaagctgcggagcacagggcgggtgtgtacgataacccatagggagcaggcaaaatgaaaaaggaagaacattatctggaaagagcctcttacacatggtcggaggattcggtcaggctgtttgccacacccagtatgacggcaaggagcctttatttttatatgcaggaagccggatatttcaaaacggtgtggccgtattttacggagagggccagtctgaattcctttctggtactctataccttatcgggagaagggcgtttaagctatgaagggcaggagtatgaggtgacggagggaacctgtttttttatccattgtatgaaacaccatgaataccatacggtaaaagggaaaaactgggaatttctgtggctgcatttcaatgggggaaatgcactgggatattatgaggaatttgttaagaatggcttccgtatactggatatcaggcagaaggaacggacggaagggctgttcagggagatcctgtccataaaccggaagagggagctgactacggaagtgcgcaccggaggcctgatcgggacgcttcttacagaattgatcgcccggaataccacggagggaagacaggccattctcattccgtcaggaatcagagccgcggaaaaatatctggaacagcatttccgggaaaaggtaatgcttcaggagcttgcggatatgctgcacatggataaattctgcctgatcaaggagttcagccgttatgtgggaatctcgccccatgagtatcagattgaactccgcctgtcctatgcaaaggagcttctgaaatattcagacctttccgtcaatgaaatcgcctatgcctgcggtgtgaatcagacctcccattttatcggccttttcaaagatcgggagcatattacgccggcaaagttcaggaaggaatggaggacacagctataaaccgataaacaaattccgcggagaagtaagataaatccatatagttactttctggtgcctatgctgcttttggatacttatattactttttggtacctatcttactttttggtacttataccactttcaggtacgttcttgcacccgttatccatccggcctataattcgggtataaggaacggccggttctctcagccatgccggacgcggcatggataactgcattccgataacggatgcataacaggcagtataagtatgagaaagggcagaaaataatgaatagagcagttgaattttttaaggcaaatccggtacagtacctcgcgaccgtaggaagggacggaaaggcaaaatgccgtccgtttatgttctgttttgaaaaggaaggcagactgtggttttgtacgaacagccagaaagatgtttataaagacatgcaggccaatcctgagattgaagtctgtgtttccgactcttcctatgcatggatcagagtacacgggaaagcggtatttgaaaatgacatgcaggtaaaggaagcctgtatggataatccgattgtaaaagggcagtataaaaccgctgacaatccgatttttgaagtgttttatctggaggatccgcatggggtcatcgcggatttctctggaaatccgccgtatgaattctgacagcagcagcccggtgtctgtctgaacaaggcggcatcgggcagagggatttctcctccggaagaatctaatcttcttccggagaagcggatgcgatatgatttttataccaggttccccagtccaccatggaatccataatgggtttcaggctgtagcctgtttcggtaagcgtgtattctactctagggggaacttccggatatactttgcgggtgagcagcccggcggcctccatggagcgaagattgctggtgagtaccttctgtgtaattccggtaacggaacgcatcaattcactgaagcgtttggtgccggagagcaggtcgcggatgatgagaaccttccatttatcgccaataagctgcagggtcatttccacagggcagtcaggaatttttttcatgttttccatgatagagacctcctttagtatattgccggatgtatatgccttatagtatgtactgctctattatatattttaaagaggataaaaacaagtccccagagtattgcaattgcataagaaccgggaggtattgtatgacagagacaaaaaagcaggatgctgtgacagagtcggagaaggagcttcacagatgcctggaacaggcggaagcagtcgttatcggtgcgggcagcggcctgtccgcagcggcgggcttcacatattccggaaagcgttttgaggagcatttccgggagtttatcgaaaaatatggaatgacggatatgtattcggccggtttttatccttttgcgtcgcaggaggaaaaatgggcctattggagcaggcacatttattacaatcgttatgaccagcctgccggtacggcatatacgcagatgctttcccttgtaaaggaaagaaattatttcgttatcactacgaatgtggatcaccagttcagccttgccggttttgaggaatcccggatttttgccgtacagggggattatggcctgtttcagtgtaaaaaagcatgccacaaaaagctgtatgataatgaaaggcaggtgcgcgccatgctcgcccggcagaaaaactgccgcatcccttccgaactggttcccaaatgtccggtatgcgggggagatatggaggtgaatctgcggtgtgacattttttttgtggaggatgaggcatggcatcatacggcagaagggtatgaacgctttatccgggaaaacagcgggaaaaaggttctgttcctggagctgggcgtggggatgaatacgccggggatcattaaatatcccttctggcagctgacgtggcagaatccccgggcatcatatgtctgcattaatctgggggaagccctggctcccgaagaaatcagggagcgttccctgtgtataaacggggatatctgtaaggtgatttcggaggttttgaaggaaggagagaaagacaatgaatcagacggaaaaaagatgctggctgattaaagagcttcagtcagatatgccggaatacggcgcactcacgatcccggaaacaccggaggaacaaaaaaaactgctgcgttccctgatgaacgtccggcctgcgaagcctgtttcggaagcttttctgcagatacaggacgaatatctccgggaagagtcccggcttcggggaatatgcgacggaatgactctgcccggtgtgaaggcggatgggcgtatttctctgtggaagggcgatattaccgcattaaaagtcggagccatcgtaaatgcggcaaacagcgcattaataggctgtttcattccctgccatgcctgtattgacaacgcgatccacagctttgccgggattcagctccgtctggagtgtgatgccctgatgaaccggcagggacatgaagagcctgtcgggcacgcgaagctgacccgtgcctataatcttccctgttcctatgtactgcatacggtagggcctgtaatacaggggcgggtgagtgaagaagacaggagccttcttgcctcctgttaccgctcctgcctggaaacggcagcggccaacggaatcacaagcgttgccttctgctgcatttcaacgggagtctttcattttcccaaccgtccggcggctgaaatcgcggtaaaaacggtgagagagtttttggaaaaggatatccgtatgacgaagatcgtatttaatgtatttaaagattccgatctggaaatatatcaggatctgcttaactgataaagctgtttccgatactggtcgagcagccgcggaagttcctcccatttttccagctccccgttttggaggagcttatcctcgatcatacaggagcggataagcaggttataatagagctggggatcacccgtggccggattccctgttttcaccagatgttcggtaatggttttgtattttgtccaaagctgcctggtggccctggcccggctgtacgggaaaataaggcagttgacaagccatgcgactgctgcgccggccagaatatagcccaggcggatgacaaaaatgcccgctatatcaggaaaacggaaggcctccatgaaaacagcgcctcccagggcgcccacggtagagcaggcgtaggtttcccggtagtctgtaaaataaaaagaaagatagccggagagcatcatggcggcggtgcgtcctgaggcggaaggaacgagggaataaatgataacggatacaagccctcctatgagggtggcgctgatcctttttttcgtctttgccggcacatcgtccgcgtaaggaagggacagggaggccagcgtgaacaaaagccattttccgtggggcagcgccagctgctgcacaagcagggtggcgcaggccagaagcagcgcggtccggagagcgtagacaattctcacggggctgatgtccaacacggctgtcagctgcagcttcagggaaagaagcgttctgtgataatgctttttttcctggggatccgtcatatggcaaaggctggcgtaaatattattcaggcattcagaaagcgcctgcatatgttccccctccgctccggaaagagaagaacaggagggcgggggcagttccccggattcctgccggagaaaggcctggtatttttccagacagtctgacattccggccagaagctgttcctcttcatcggaaagcctttccgggagctcatgcagaagaaacagcagatgctcaaggccgcagccggctgaaaacatggaaaaaccggcatcactgatacagagagccttttttctgcgatcatatatcgtccggctcagactgtaaagcttgctgcgtatgccggaaggcctcggcggctcggactgttccttcagccggaaggctatataattccgaatttcatctgtcatttcacacaacacatccctggcggtttccgccactcggttccgtcccataaaccactgatacaacagaatggaagccgctccgaaaagcatgccccatattcttttaggaagctgctgcgcgcttatgggagcgaggaaaatcaggaacagataggataaaatataggggaaatacatattgctggagtattcgtaggtgaaagaatacaatatcagcaggagcgtgataaaatggatgataaatgccagaggaaccggcagggtatttacccagaaggctgccagcgccatccataccagaaccagtgactggatacacagatgcctcaccggtgtggcggtcagatcgcgcaccatggaggcggacatcataatggtaaatataacggctacaatggaattttcctgcccgaagaggaaggtaaaaaaattaatataaacaagaataaagagaaagctcagcgtattgaagcgaaagccagactttattttttctccgatttttcgtatggtactcatgaattaccgcctttctttcataaattaacatctttcagaggattgacagaaaaagaaattcctgtataatcgtaagaaacaatcatagattgatgatagtcatgttttgtttactaatttactagaatagcacttcccttattttttgtcaacgggaagaaaaggatagggagaatgaaaggatgaaatcagagaagggtgcggaaatgtttgtatataagcttttgcaggtaatgccggactggcattccagattggtacggcctttcaaggaaaagctgaacggggagatgagcctggaaacctattactgccttcagacactccggatgcgggggctggcgaccatgacggaactggcccatgaactgaaggttcccaaacagcaggtcacgaaattggtggataagctgtgcgaatgcgaatttgtggaacgggtgcagcatgcggaggatcgcagatccgtctgtatccgtctgacgcccaaagcggtagcctatctggattcctattacacaaaaaacagggccttcatagaaagcctggaagaacagctgacggaagaagatatcatgagactgaaccaggccgtggggatactgagtgatatattacctaaattaaggtaggaagtcctgtccgtcacatgtgtttatcctctcccggcagccgaaaaagggaagtcttatgaaaactaccccggaaactcgtcaaacgtaatcggccgtatcagcttcccaagagatcggattgcaggttcctcctcccggatgccaggcatagctgcccgtgtgatctgcctgttattataggtagtgaaaaagtattcttgagtggaaagtctgatgaaggcggtgtattgagtgaaatccgctgtattcctgtccgtcatgaccacccctttcggaatgctgacattttccataagatggaaccctgtgatgacagcctcctccggagtggaacatgaatccgcatgacttttttgaaaagccgttcttacgaaacgtgacggaggagaatagtcacccggcagcccaaagccgcccgttccctgcccgaaaggaggcagctgtaccccgcaccattttttatcctgcatctgccagggtgaaaggttgctataatttctcagattagttatctgccacgaaaaatccgggctgttcgtaaggatccctatcgggttatccattacgaacagtccttcttttgtcttctcaatgaccgcacacctgccgcttttatccgccatgatccaatgaagcggcgcaaccgattcggtaacaggatcctccatccccacgatccggatcgtacgaagaatctctgccgcgtcatccacatccgtacactgactcagaagaaaatgcataagctcaatcgaggctatgggcggcctcgtatcctgcccggaatcaagaggatcataatacgcataacccggaaaatacaaaacggccgccccgaaccctttttcattcaccccatccacaaaaacaaccggagaagcatcctgccccaccgcaataaaactatattggttccggaccgtatgcgtagcagccagattcccccaccgatacccctttggaacaaaataaaggctcggatccaaagtgacggaaaaatccatggtcctccccagatacacttccccctgcgccgtttccagcgtcatcgcagtacacataaaaatcctcctcaaagaatcactattatatttatgtatattccgtacgtcagacgatggtgccgctcctgttacttgccctgcctccttgtcctttggtacctacgcttaaagccaccgaaaaaattgaacaaaaagtgataaggtattttgtatgtatggggattactcgaatattgactttcatgcttataaagtgtaacattataagcatgaaagtcaattgaagggagatattttttgtgggagcgatggaaatgattatcaaaatggcaaaagaaaacaacgggattgttactactgcaatggttgttgctgccggattctcacggggaaatctgaagtacttagttgacaggggaaagttagaacggccctcccgcggcatttatattttgccggaagtttgggaggatgagttcctgaatctgcagagccgttttagaagagggattttttcccatgaaacagctttgtttttatgggatttgacggacaggacgccgaattattattatatgacgtttccttcctcctataatcttgcaaagccaaaggagaatcatgtcaaatgtgtgcagtctgcgaaaactttgtacggtttggggattaccattttgcggacccctggtggcaacgaggttaaagtgtactgtatggagcgtaccctttgtgatattttaagacccaacagccgcgtggatatacagattgttacagatgctttcaaaagatatactgcaagacaggacaaaaatatacccttgctgtcggagtatgcaaaaaaattgaaagtggagaaaagactaagagcttatctggaggtactgctgtgaaaaatgcaatgcaattaaaggcggttattaaaaatcttgcaaaagagaaacatatatccgcgcagcttgtgatgcagaattttatgcttgaaagattgctggagcgagtgtctgtttccagataccagaagaattttatactaaagggcggtttcctgattgcggctatggtcgggcttgataccagggcgacaatggacatggatgccacaatcaagggatttcctgtaagtgaacagacaatccatgaaatgtttgaggaaatctgtaagatagaactgaatgatgatgtggcattttcgttcaggcatattgggaaaatccgggaaggcgatgaatatacaggataccgcattgctttaaccgcaaattatcccccgatgtctgtcccgttaaagctggatattaccacaggcgataaaattatgccaaaagaaattgaatacaaatttaagcttctcctggaggaaaggagcattacaatactggcatataatctggaaacggtactggcagaaaagctggaaactatactgtccaggggcgatcagaatacgcgttccagagactattatgatatctacatactggcaaagctgcaatataagaatatccggccggagactttaaaagcggcgctgcttgcaacaacggaaaaaaggggttctgctttcgtgacggggcactataaggaaattatggaaaccgtcaaggcaagcggggttatgcagaaacagtggctggattatcagaaggattttgagtatgccgctgatattgcctttttggatacctgcaacaccgtcatgctgctaatggacgggctgaccggaagatagcggcagaggcgggcaggaaggaatctttaatttccccggatagtgttgtcctgctgagcggaaaagcaattgcctgtcaatgtggtttagtgctagaatggttttataaaagcgataaggagtccgaagatggataagcagagggtaaggatagtaaggaagaatgatgagttctcggcggaatatcaggttggggatgtttttgaggttgacagtacgtggtacggcggggtgaatgtgagcagcaaaacgggaattccgctgtctttggataaggaagagtatgaggtttatgaagaggatggggaggaagaacggaaggtggatccgtattcctatcatttgggggctatggactgcttctgcgagatggtgggagcgggggtgaaaaccctggctatgagtcatccctgcgattccaggcaggagagggattcttttctgaaggatgtaaagaagctttgtgaaaaatatggagtttatttttatgcggaggatgaagcctttctgacggatttgtttccggagagactgaacaaagggaaatataattatttgttttatgcccgtaaagaggtacttgacgcgtactttgaactgaaggaagagcagagggtagtcattcaaaatggcggctataccagacagaaaagctatgagatcgcaaagaaattcggccgtcttttatcttatacggaggaagggacggagcggctgattcagaaggcgtcggaggacagggaggttggtgaagcggattgaaaagaaagatagggcggcgcttgttcagaacaggtctgcttttgcttatggctttcttttttacaggggtaacgctcttcggtgaacaggttcccgcctcggtggaagcctcttccggggacggtccggaggaactgcagagaagatatgaggagtaccggcagcggtttgagtcaatacagaagatatcggatatacccggacaggattttaatattataggctcccaggtgtttccggtgacgctggaaacctatggggagatcttgtttatacccgccctggacgcccattataaccggatggctattttcctggcggatgaagatgaaaatattgtatacaaaacggatcagctggaatcgaataaccggaataagggggaactgcggcagcccaaccaggggatcgcggcggtatcctttcaggatgtggatgaggacgggcttacggatattgtgctgatcactacctgtaaaaatgaaaacaaggccttttccagagatgattacaaggtcggggaggtattgttccggaaggaacagggcttttaccgggactggagaatatcggataagattaaccggttcagcatgaataagagcatccggtttatcacctcttttgtccggggcggaaattccgtggaatttctttacacggcgactacgcaggacgagcttctgaagaatgggtttgaaatctttaccgagctgtgttactggaggaattttgaaaagatgggcaggctccgggtggtgcccgggatttacagcatggctgactatgatgtgtttatgatttatctggtgaatgagcagggatatattgtatggagcttccagcccatgcgggactatgacaatctttatgcgctgaagggaattacctgcaaggatatagacggagacgggctgaaggatattgtggtgctggcacgctacagctatgaggatgacaacaacgagcaggtcattgtcagtgattatgatatttattaccagaggaccggcgggttttacgaggatacggagtttaagaagctgtataaaagcagcgaggacgatacgatggaggggctggtacagaaggcccgggcttattggggatggagcgtttgaaaggagtttatgaccgcagatgataaagatacttgtagtggatgacgagaaaccgatttgcgatttgattgatctgaacctgtccgcatccggttatcagtgcaggacggtacaggatggactggaagcattgaatattattgaaagcgagccttttgatttgattttgctggatatcatgctgccgggggccgatggctatgacattatggaatacataaggcccatgggcattcctgtgattttcatcacagcaaagcatgaggtgagggatcgggtgaaggggctgaagctgggcgcggatgattacctggtaaagccgtttgatgtggtggagctggtcgccagggtggaagcggtcctgcgccgatataataaaacggatcagatcctgactgcaggggatgtgtccgtggatgtggaagcgcacagagtgacgaaggcaggaaagccggtggaactgaccaacaaggagtttggcctgcttgtgctttttatccggaataaaaacgtggccctgttcagggaaacgttgtatgaaaaggtctgggagggggaatatttcggcgacagccgtaccctggatctccacgtgcagcgtcttcgcaggaagctgggatgggaacacagtctggtggcggtatataaagtagggtaccgcttagaggtatcataatgaaattttccttaaagctgctgctgtgtacgatgattgtaatggcgctggcgttcggattcagcgggttttattttgtgaattatgtgtttgaaacctccctggacagggagataaagcaggctttggatgaaagcagcatcctgcgctttgcttttgaaacggcggccctgaatgtgccggctaaatacgatgtgcttcaggatcatacggtggagcagatcgcctccaacctggaaacaggcggacacgataccagccgtatgctccgggtttccgacgagcataaaaatgtgctgtatatcagcagcggttttgatgccgaaggggggattctggagcagacggatgaaaataccaggacataccgggtgatacgccgggaagaccggtattatatccagaccgggatgaccgtgaatgcactggaccggatcctgtatctggaaaccatgaaggatgtgtcggaagtgttccgggaaagagccctgggcttttccgtttaccgcagggttacgataatcatgctgattctggggacggtgatcatgcatttgattgcctccttcctcagcaagcctatccggctgctcacaaaagccaccaagagaatgtccgccggagattacagctaccgggcaaggcaggtgagcaacgatgagctggggcagctgaccatggattttaacctgatggctaacgtgctggaggataatatcagcaagctggaggaggaaatccaggcgagggaggattttgtggcggcctttgcccatgaactgaaaacgccccttaccgccataatcggctatgcggatatgcttcgttcccggaagctggatgaggaaaaaagctttatgtcggccaattatatttatacggaaggaaaacgtctggaggccatgtccctgcggctccttgaaattattgtgaccaaaagggaaaagattgatttccagaaggtttcggcggagatgctgttcacttatcttgagaatatgtttgtcaccaaccgggatatggagttccatttttcctatgaaccggggatggtgtgggcagaggcgaacctgatcaaatcggtcctggtaaatctgctggataatgcctgcaaagcctctgaaccgggaagccccatagaggttaccggcgcccggctggaaaacggttaccgtttttccgtgaaggatcagggagtgggcattccgaaggaagagcagaaaaatattatcaaggctttttatatggtggacaaatcccgttcccgaagcaaaaacggggccgggttagggctggctctgtgcacgcagatactgcttctgcacggaagcaggctggaaattgacagtaccccggggaaaggctcctgtatcagctttgtcctgccggatcgaggagaagaggaatgaaaaagaaagtaaggaacctgtcctttttgctgtttgtggttctgattatggcgctttccatatgggggccggaagccctggctaaatataaggatcgggcaattctggatgaaacccatgagcagaccgtagaatccgcgtcggaaggctaccggtatacattgaacagcaatgaaaagctgtatatcctgtcccggtgcctgaacagccagagcctgccggaaagcgaacagaacgctttaacaaggaaagaagcggaaaatgtggatttcccggatctggaaggggcctatgcttttgtggtgaatcacagagggccttccggaaaggaaatcaccagtgaggaaatttatgaggcctgcaataaggggctggaaatgctgaaggaactggatatcctgccggacggagtgcggaaggtggacgcggcatcttatgacgccaccctgtattccgccattgatgtgccggagcctcagaataatgtggcggtctggaaaatgagcctgtccacaagccagaaaaacgccaacaaggaaaaccgcctgatcgatgcctatattgacgcggatgacgggaaaatctatgaattttatgtccgcacctcccgggtgtgggaggatatggatccggatgagattgcggccaggtggagcggatatatgggccttacggatccggagccttatgaagccgccaatccgctgatggaatccacaccgtattttaaaaaatatgtatacagcggcatggggaatgaggaaacgatcgttacgatcgggttttatgaaggcattaatgaattgtttttgaaaatttcaaaataatgcagttttgatacaagttgccgggcagacatcagactgatgtctgcttatttgatccggaaggtttccggtgccttccggtataccaggattaatgccgtcatgatatacagtaccgtaaatacaagcacccccagtgtaaagaaactgccttttaccctgatttccagacagagaaagcaaaggacatacatgatcacgttaatgatggaaaaaaacgggttttttattttaaggctttccgaataaggctggaaaatatagtaaagacaaagatgatgagccgtaaaaagcacggacagcagcaaaatggtgagacagaacagcagcatatccggagtgaaaatactggtgccggacagcaggcagaataaaattgccgcgaggcacagtgctgcagctatgataccatcataaagagaaacatacagaagacggatccggaagatgcttaatatagtatccggtcttcggtaaaaagaataatgcagcatatccttgtcacagttgtagaacatcgcacggcaggccttatccgccaccgtgaggaaatacataacatagacaaagaacggcagcagaagggttgtcatattggcgctcaggttttgggccgcctgccggttgacagcgagcaggacgatggaggcggcgaacagggcgcccactatcagcagacgatagtatacaggccgaagcagctgccgcctgtgccgggcaaaaaacagggaattgaagtaagcatagccctggttcgaggatgaatgcggccttaaggaacggggaatttccacatccttttcctgtatttccacttccttgaaggaggaaccggaggaggttttcagtatggaagacagaagaaaattcaggtcgatggaacgaggcagctttttttcgtattcccggtaaccggttataatataggaaaggctgacgccgccgaggatcaggtacagaagcgtcatgataggatgaaggagaacggaggccggtaagcagattccaaggaagggaagcagatatcctccgatcagaccgactccgataatcgtccagctgcaagccatattccggttataaaccttgcccgtgcggtcgaatatgtaaagctgaaaagcctcccccatcatacggaaagcggccagcataatccaaagaaagaacccctgtaccgcagtaccgcccagaagcttgataaagagaatgagaaagggcaggtaacaaaggaaaaaaggaatatatttcaaggccaaagcggcaagcgtatagctgcgtgcatcctgatgcatatatttgattatagtaattttatcccttgttacagcgaaaatctggctgtctcccaaagaacccagaatacagttcaggaaaaataatatattaaccatcagggaaacagagtgtccctgtaaggattgccggctttcggtcagaagcaggccgggtaccaggacaaagaaaagcagatacagcggcttgcctgcaagctcaataagctggcgtatgatgaaagcggccagcgacagcttgtgcttcagagagtaattggagtacagggaatccggcatccatttgccgataagccaaagccgctttaaataatagataaagctgtttacccagagggttgttttcaatgatattatctgtttcagtacattactcatgtgcattatcatcctttaacaattctataatccgctcttcgaaatctttgccggcaagcaggttatgatcgatctgctgcagattaccttcgctgagcaccgcgatttcatcacagaggtctgtggcaagctggagaatgtgggtggaaaaaatgattatatgatcctgcttcagttcacgcagaagctgcttgatttccagggccaccaccacatcgaaggaggtcagaggttcatccagcaggataacagggggacgggctatgataaaacagagcatctggaccttgtttttcattccgtgggaatatcctttaatcagcttgtgtctgtcctccttatccatttttaccatatcgaaatattcgtcaatggtcttttcaggagttctcttcccctgatggatatccatataaaaacggatgaattcatagccggtgagaaaatcaggcagaatcggagtggagaagacataacccacctgcgaaggaatcagcggttttgtacttccgtcttcatcgataaggaatgcctctccggcgtccgcccggacttcatcggtaaggcagttgaacagagtggtttttccggccccgtttcttcccagaagaccgtagattttccctctttcaaaggaaaaggtacagtccttcagaacggtctttgtcccatagtttttctgaatgtgttctaattgcagtatcatgtaaaacctccgtttcttctgaaaataaacaaacaggtatagcctgcattcccgctgagggcagactatacctgtattttcctgtaaatagtaaatatatgaaaaataagacgtaatgcaaaaaaatatacgatcgggcagcgtcaccagaggcgtcgtccatggtctctatcctttcataagcaaaaataaaatattgaaaacaattataaataagaaacgggaatagcacaagggctatagatatatctttacataatctttacattaacggttcagacgccgtgcggcaggtgcgcggtacgatctgatcagcaacgtaatgtttccgaaaatgagacaaacataacagcagggcattgcttcgaaaagtaaatgcatgataaaatgagacaaaagagtcatcgggattactgcttgtaaagaaaaacggaggcaaaaggatgagagagatcaatcattttaatgattttataaaagaactgtggtccgtgggatttaccataggaggagaaaacggggagggtgtctttactttaagcgacgctttcggagaaagcattgcgtggcacacagaggatccggagacagatccatgggaatggcggatacgggttctggacgagtatacggatatcgcttacgggaaactgtttttccgtaaaagcggctatattacaaaggaatggtacccatattttctggcggtgcggcgagggaaaaaagaacttcaggaggaatatgaagaaggcaatgtcactctcatggcaaagcggatttatgatgtcctcagtgaggaaaaagagcttccggttcatttgctgaagcagtacggcggtttttcgggagaggataagtcaggctttgacaaagcccttacgcagctgcagatggatttctatatttccatatgcgggcgggcaaggaagcgttcccgcagcggggaagaatatggctggtcatccaccgttttctgccttacggaaaacctgtttgaagaggaggttttccgtaaggccggaaaattatcttatgaacaggccttcaaacggatagaaaagcagatttatctgcagaatccgcaggccaggaatacaaaggtcaataagtttattaccggatgagactgaccggaagctggaaagcttccggcaggcgtcatattaaacgacctggtatttcgctacataaacagggaagctgtccgtacctttaagtttcttatcggcagtgatggtcacatccttatcggatatgatatattccagctccgctccgggttcgatcacggtatcctgcatcagcacacagtttttcaccttggcgcctcttcctactttgacccctcggaaaaggatgctgttttccacttccccttcgataatacagccgtcagccgccataatattgtctgctctggccccttccatataacgggtgggattgtcgtcacggattttggtataaatatggttgcttccgaagagggcatccagattttcgtcatccagaagcttcatgttttcatcaaaataactcttgatactgctgatccgcgccagataaccggtgaatttatacgcctgcacattcagcttatccagctggggagccacaatatcccgttcgaaatagacatggcctctgacgaatgcggcactgacctggctgatcagaagctccctgtccataatataaatgttcatggacagattctggactccgggcgtttccgggttgatctggatttcttttacccgtccgtcttcaatatccagcgtataatacaaatccttattgatatcaaagggcttaatcagtccctttggaatttcttcctgcgcataggccagggtcagatcggcaccgctttcaatatgggcgttcagcatcgccttgaaatcaaaattagcggcgatattggcctctgacataatgacatatttttccttctgatccttcagaaaatccagaatgcttgcgagagcctccacacggccgttataaaccttcaccgttttttccgcaaagggagggacgatattcaggccgccgtttttgcgggttaaatcccatgcccgcccggaacccagatgatccatgagggaatggtaatttttccgtacaataacggaaacattgtcgataccgcagttcaccatgctggataaaacaaaatccaccatccggtaacgtcccgcaaagggaatggaagccatcaggcgctctgcaaccagttcgggtaccagtgaatcatagccgttggggaaaatgatgcccagtgcatttgcgttggaatttaccattcttcttcaccatcctttacattttgttcgatcatggcatcagggccgatttttgccccggcgccgatatataccccggatcctacggttgccactccggtagaatcaccttcaggcatggctcccacaactgcattttcaccgattaccacattttctgcaatgatgcagtgctccacaacagcgccggccttgatgacggtcccgcccataactacggcatcctccactttggctcccggctcaacgataacgccggcaaacaggaccgaatgctttacatgtccgccgatacggcagccgtccgtgatcatggagttctcaacaatagccccggaggctatcttatggccggtcataccgctgttccggctgtatattttccagttgtcatcaaaaagattaattccgctgtgctccggatccagcacctccatgttggcttcccagagagaagcgattgttcccacatccttccagtaaccgctgaagtggtaggcgtacatttcccgtccgtccctcagcaggctgggaatgatattattgccgaagtcattttcagaatcaggatccgcttcatcctccatcagatactttttgagcacatcccaattgaaaatgtagattcccatggaggccagattggatttcggttttttgggtttttcctggaactcggtgattttgtcgttttcatcggcaaccatgaggccgaaacgggaggcttcctcccaggggacttccattacggctacactgaattcggcacccttttccttatgaaaacgcagaaaatcactgtaatcctgcttgcagatctgatccccggaaagaatgatgacatattccggatcgtagcgttcgataaacgggatgttctgatagatagcattggctgtgcccttataccagtcggagccggaggccttctgatagggcggcaggacatgtacccctccatgaaggcggtcaaggtcccagggctgtccgtttccgatgtattcgttgagtaccattggctgatactgcgttaaaatccctacggtatcgataccggaattaacgcagttggacagcggaaaatcgataatacggtattttccgccaaaagggacagcaggttttgccaatttttgggtcagggcgtatagtcgggagccctggccgccggcaagaagcattgcgatcatttcttttgccataagtgattccccctgtttggttatttggtatggtaaaagtgtaccacaaaatgggatattaggacagccttttgtgcataacaatcaaaaaaatatgtgtggggggagcccgtatcatttccacgtccgccctgcatgcagcctgtccctcgcccggctcaccctcccggcccgtcatcacccgggtattaccaggcagcatacgctatggagggacagtggcagacaaaaaaagaggctgtttctaactattttgtgtcaacactccgctgccaacgcagctgaactcctccctgcggtcgtcagacaccgctgctaagggcgggcagtggagcattggcgcaaaatagtaagaaacagctctctttttttgagatgccactgtccctccatagcgtatgctgcctggtaatacccgggtgatgacgggccgggagggtgagccgggcgagggacaggctgcgtgcagggcggacgtggaaatgatacgggctccttgaaggttataatggtatagcttgtaatggaggtgttgatataaatgttgagtcctttgaaggtaataacattacagggttttggcggcttgtttgttccagtagctgacgagcatggagaggagggcggtgagggtgaagatgagccagattttggtttggaggtgttcgaggaggaagccgtacattatctggccggcgggttgggcgcaggaggagagggctatgatccaggagatgactttgcctatcagggctgcgggggtggtgagctggatgtaggacatgatctggatggtgtatagggaggcaagggccatgatgaggaggccggagagggctattattgtgtaggcggcgtaggcggggattgccggctggagggcggctcccatggggatgaggaggagggaggaggtgaagaggagcttccagctgtttcggatattgagttttttgctgaagattccggcagccatgccgcctgcgaggcctccggctgccatgagggcctggaggaagccgtacatttcagaggcgtttcctttggggaaggagaggatctgcatgacgattacgggcaggctgatgatcatgagggcggagaggaagaagtttacggcggtgcagcagagggtcagtttgccgatttcctttttttcacgggtgatgaagaggaggctttcttttatgtcaccggcgagttcgcggaagagggagcaggtgagttctttgcgggtaaaggggatgtgaatgaaaagctccatgagggcggagaggaaaaagcagccggcgcagaggtaaaggatgggggtgattccccacagtccgtaggctattccgccgagggcggggccgagcaggccggagagggaggagatcatgttgatgagggcgttggcgggcatgatggcttcttctgttaccagcagggggatgctggcctggacggagggctggtaggcgccggaaatgccgtacagcaggaacagcatgacaagaatcaggcctacgaggctgactctgccggagaggagaagaaaggcgaggaccaggccggcggtgaaaaagtccaggactaccatgatattccgtttgtttacgcggtcggcaatcaggccgcctacgggagacataaccgcaaggggcaggaaggcgaagccggatacgattccaagcagggaaggggagtgggtgacggacaggaggtgaagggggagggcaaagcggattaccgcatttccaaacagggagatgatctgtcctatcagtacaaggtaaaagtctttagaaaatccttttttcataatgcctccattgatacgattttttttgataagtttccgtagacaaataaaaagacgacagccatgatgagggtaaaaacaatcaggctcagtccgccgtacaggtttgccgacgccatattggtcatgggagcgatgaggatgagggccgaaacgatgacggcggtgggggatttcttccagaagccgaaccggacggcggcaaggcagatgcaggaggccagcagggcaatggagaagctgaccagaaggagatagcccaaatcatcagccgtaaaggctccgggaaatccgtggaacaggttagataagagtaaggtcgttaaaactgccaataaattggaaataaaggtgccggcaatcgtgaaaaggaagagaaaggctgttttggcggcaaaaaggcgtttgcggctgattggccaggaaaaaaccaaaagtttgttttttcccaggaattcggtaaggatcactctggaacttaagacggcgcccagcatggtataggaaaaaagggtgacgcaggataccagaaggatcaggaaatgccagttacgggaaagtgacatttgggcaggcccccattccgattcgggaagaaagcagaaaagaagagcgataagcatgctgagggccagcaggccgagagcggtgcccaggtagggggcaggatttattttttcccattcaagacgtatcagtttcattcggtttctcctttcatggcagcgagcacttcctgttcaaaggcttctttccggctgccccggtattgttccatatcgaattccctgcagatccggtgaccggaaaggatccctacggtgtcggccatagcagagatatcactgagtatatggctggaaatcagcagtgtctttccttcttcggccaggctgacaaagagggaacgcagttcctccgcccccagaggatccaggccgttcagaggttcatccaaaagaaggacccggggattatgaagcagggccctggcaatggcaagcctctggcgcatgccggtggaaaaagcggagacgggcttttcactgattccggaaagccctaccttttccaggatgccgccgatatcggtatctgttttctggtaagcctgctgcagcttcagattttcaacggcggagaggtgttcatagaatacggggacgtcaatcagagtgccgatatctttctggatactttcccggttttcccaggtctgctttccctgtacccggatttccccgatatcagggcagaggaaaccggcggccagcttcagcagagtggatttccctgcgccgttccttccggccagcgcatagatggcgccatccggcacctggaaagaacagccttccaaaacgggggtggctgcataggccttgcttatgtttgtaatagttatcatagattcctcctaattattaataccaaccgttggtatgtataatgataaaaataatctgctccggaaggagcagttatttctgacatgaaaagagacttaacgatccttgttttcctgataaagctgtgaatatttttcaagctgggtgaacatttcatcttcaatgatatccaaaccgaagacgcgcagcatatgctggaaaaatttcagcttattcagaagctgttcggtatcgcagggataaaccataggattcagccagagatttcctatgagcatcagaacctccgccagttccctggggtattcggtccggatggagccgtccgcgattccttcttccagaatgggctggatcatggcaggcgattccttctgtacggaattacgcagatagagaaccagcagctgaggattattcatcatatcgggtgccgctgagaacagctcttcctgggcggaagaatacatggaagtctggaatatcatcctcagcttttccaggccggtgagatccttcctgcgggcaatgacccacatactttccgtcgccccggcataaagtttatccgcaacagcgttcataatctcatcctttgatttaaaatgatgataaatggcgcccttgctcagccctcccaaattattgatgatatcctgtatggaagtgtgctcatatcccttttccacaaacagcctggcagccgtatcaataatcagattccgcgtttcttccggatatttattccttgccataagagtcctccctttttcccgggattatctgtattaaactcagtttcccttttatatttacataccgttggtaggtttaattatacatactaacggtatgtatgtcaatacacatttataattacttacactttgcaaagacagctttccgtaccatccgctgcttccatgtctgccgcccggcctgagaacccctccctgcccttttccgttgccggccctgacagccatacaggggatcctgtaaggggcgtcataagctcgccggtccttaggctgcgtactgtgcagccttagtaccgctgcgtgcttatccgagcgaaagcgtcccctctaaggacccctgtatggctgtcagggccggcaacggaaaagggcagggaggggttctcaggccgggcggcagacacggaagcagcggatggtacggaaagctgtccctccaaaatataacatcatttaaaaaagtatccccataaataaaggtatcattaccaattccggaaagggtatgttataatcgtaactaagggtttgaaagaactgcaaaagaccgagggcgtataaaaggggagaagcatagagttggacagcagggaacataagaaaaaatttaacagggtggatgtgcaggtattcattatgacgatagtaatagtggttatttcctgcagtcttattttcctgattaattacgggctatcttataataatatgatcatggatctgaaacacaggtcgacgaatctccatgattatctggaaaaatatctggatgcggatatgttcagtgaactgaacgtgaaagaggacgacggactgattttataccagaattcccgtctgaggctggagggcgccagaaatgcggcgggcgtgcgttatctttatacggctaaagtaacggataagggacagtttatctatctggtggacgggcttcccacggacagtccggatttccgttatgtgggagatcccatcgaagcggaatgcattcctgatatgaagcgggccctttcgggggaaacggtatttcccaatgaaatcaataaaacaacctggggaccggtgttcatatcttattttcccatgcatgacggggataaggttatcggggttctcggcattgaattcgatgctaccagccagtacaacacttaccggcttatgaaaattaccacgccgatagtccttcttttatcctgtattgcggcggctgtcgttgcggtactgatgttccgccgcatatccaatccgctatataaggatttgtccaatacggacatgcttacgggactgaaaaacaggaatgcatttgaggtggaccttcataactgggatcaatacgaggggaaaaaggagcttgccattctttcctttgatttggatcggctgaaggatgtgaatgatatttacggccatgccaagggcgacgagtacctgatccttggaagctccatcatcggggaagccctttacgggaaatatgttctgtaccggataggcggagatgaattcgtggcggttatacagaatggaaagccggaggaagtggatggaatgttccgggaaatcggagtgatggcggagcaggaaagcaggaaccagggctatgaggtgagtatttcctcaggctatgctttttacgatcctgagcaggataagaagctggctgacacactcaggcgttcagatgcgtggatgtaccggaataaaagaaagcgggaatatggaatctgggaaaaagaggatcggaagaaggaagacttgattggggaaggcaatgagaatgacaacagggaaggggagcgcagtgaggaggacagctaggtcaggggggaatatatggatgaggaaaagatcgtttctattataaatgagaattacgatatgcatgtgaagcaggcggtgtttttccgtgacggagggagcctttcctatacggtggaatcggataaaggaaaatattttctccggattgtgcgcccccagctgatggatactgcggtggaagcggtcaagatccagctgtttttgatgaaaaagcatttacctgtgtcacagatcatttctgatataaagggggaaccctatgtcagccgggagctgcagggagaaaagtatctttatatcctgtatgagtacatagaaggaacggatcccgggccggaggatatggaacaggcgggagaactggttggacggcttcacaattgtatggaggagtacggcggagaactcaaagtacgggataaggatttttttatcgaccggtatatcgccatcctcagaaaaaagaaatatgcaagggccgatgaatttgaggcctatggaaatgaggcctgggataaggtaaagcatctgccggcgggctattgtcatggggatttgtacagaaacaatatttttatggcagatacaggagagctgtatgttttggattttgatacctcctgccgttccttccccgtgtatgatattgctctgttctgcaatgaaacggattattttacctttcatgaagatgcttatgacaagacggtctgtatgctggaacagtttctgaagggttatcaaaggcacagaagcctgagcagggaagagaaggaagccatatttgatttgcttgctgtttaccattttcagctccaggccaccataattgagatctatgggcctgactgtgtggacgacgagttcctggataatcagctggactggctgtaccgctggaaagcgcagtgtgcctcccgggcggcagaaccttaaaatagagtgactgataataatttgctgaaaaggaagaggagtgaaggacatggaagaaatgaaaaagatcagaccaggagattccaatcagattacgagggagtattttgactctcttttagtggaaatgcgccatctggatggagcactgcctgaaacggggctggaattgttcggagaacagtttagcacacctgtaatgacggccgccttatcccatctgggcaatgtgcgtgaaaatggcatggttcaaatggcagaaggcgcacggctggcaggcgcggtgagctgggccggaatgggtgatgaaaaggagctggaggatattaccgcgaccggagcaaggacgattaagattatcaagccctatgtggataatgattatatcctcaaaagaattgcgcacgcggaaaaatgcggagtgatggctgtggggatggatattgaccatgcgttctcaggaaaagggaaatacgatgtggtattgggcatggaaatgcgcccgaagtccctggaggaaatgaaggagtttgtgaaggcgacgaaactgcccttcgtggtaaaaggcgtgctcagtgtgaaggatgctgaaaaatgtctggaagccggggtaaaggggattgtggtatcccaccatcacggaattatcgattatgcggttcccccgctgatgatcctgcctgaaatagtcagagtcgtgcagaaacagattcctgtatttgtggactgcggaattgagagcggatccgatgtgttcaaggcattggcactcggagcggacgccgtttgtgtgggcagggcgctcatgggggctctgcaggtaaatggtgcggagggcgtacaggaaaaaatcgcctctctgacagaagaactggctggtattatggcaagaacaggggcatcggatttatcacaaatagatccttcagttatatggaaagcgtgatttcagggaatccctttccgcacacaaagcgccgtcctatggaaacagggcggcgttttgtgtatggaaagagcggagaaaaacaggctgttttgtatcgctgaaaaggggaataaaaaatattttctgcaattgtcgaaaataaccttgacaattatataagacaactgtagaatacaaatatagacagctgtcttaaaggagttgatgagatgaagcagatgaaaaaattaccggacgcggagtttgacattatgaaggtggtgtgggcgaatgaaccgcctgttacgacaaacatcattatggagcagcttggaacggaaaagagctggaaagcacagaccgttatatcccttatgctccggcttgcagaacgtggatttttaagcacagataaaagaggaaaggaacgcatttattatcctctgataagcaaggatgagtacctgaagtttgaaacaagcaattttatgaagcagtatcacgacaattctttcctcgatcttgtgaacacgctttatgaggacaaggcattgacggataaggacattgacgaattgctccaatgggcaaaaaagcggagggattaaaatgaaaggctttatggttatgctgttgatatgctccgttactatgtctgcggccgcacttttttatatggccgcgacaccgcttttggcaaagcattattctgtgaaagcccgctattattcgtggcttgtcattattatcgggcttatcattcccttccggccgaaattcggcaatgcccttgtcagggtgaatgtgccggacagcccggcagtatcggttatccggctagggaacgggacatcggttcctgccgccgtccctgctggaaatgcggttccttctgctctgccgaatataccctggtggcagatagcgggggtattgtggctgacaggaatgatcgtatttctggtttatcatgtaatcagacatctccgctttttgaagctggtgtcacgctggagcgataacgtcactgatgacacacagctgggggtattccaaagcctgaaaacacagatgggcataacggaaagcataggcctgcaggtttgtgaaagcattggaagccctatgatgacagggtttgtaaagcctcgcatactgcttcctgatgcagattttaccacagatgagctccgccttattttaaagcatgagcttgttcattataaacgcagggatctctggtataagggcctggtgctggctgcaaacgcgatccactggtttaatcccgctgtttacctgatgacccaggcgattgacagccaatgcgaactggcctgtgatgaggaagtggtgtgcggaacgggagcggatatccgtcaatattactgcgagacaattatcggcgttatccgataccagtcaaaacgaaaaacagctttatcaacctttttttacaaagggaaaaaaggaatgaaagaaaggatattttcaattatggatatgaagaaaaagaaaacagggctttccattatggggggcgtgctcatcctgactctgggactgagttttactttgtcggcaaaggcggaaacaaaggaaccgccgaaaataatacaggaagacattaaggaagatttgtcattttcctacggattccttcccgacccgcaagtctattcacagtatgccgattttggtattacgatttcagaaaatggcaaggagctgttatacggcgggcagaaggtaaggcttttcgttgatgaatatgctaaggatggagcgctcttcttagacgaagcgggaacgcttgacctggccgttaaccgtaatgcggacggcagaatcacagggattgaaaaaatctctgaggataaagcgcagaaatatcgttccgtttattttagcgatgacatcagggctgcggcaaaggttccgaatgcagcggcagacaatacgcagaatacggcgggaaaatcgaaatatgaccaatatcaggcatatggaatcgagctttcttcagacggcaatacattatattataacggccagcgtgtgaagctgtttctggatattcttgcggatggatctgcggagacctattggagcgatgatgccgggacggtgagcttatcggtggtcagagatgtaaacggacaaataacttccatcgccaagatatcggaggaacaggcacagaaatacctttccgcgttagaggaacgggagaagaattctcttgatggtttggaggaaaaggtggaagcaaaagtgaaagagaaatttcaggacaactgattaatcgggcagaagaatccggtaccattatggcagcctgccgctgtcaggatggtaccggattctttgcgttcatatttagttcataaaaaagttacatattgttcatttgccctgaagtggacttcagggaataaaatataaattgcgattgttgcagcagtccctcccaatctattgacgcaggggagtgaatgactgtatacttattaattggagcctgaaaaactgatattccaagaataacagcatgcaccgaaggtgcaataggaattcgcccaaggcggatggttccatgtgaagagataattcgaatcgtattgattccctcgggcagcgggccaaacggatgcgccgttccggggatttaacggatggatacagcataatgcagcagatgccacgaaggcgtcgggttccctaagggaagcggactttcagggcgtctgtctttttttacagcaggcagtcacaggccgtaagacaagggaaagacggccggtgtttctgacggaaaggggcagacagaaaacaggaggagattcaagtgaggaaaaagagaatagcagcatttttatgcgccgcagtcattgcggctgccggacttgccggctgcggaggcacaaaggcgccggcagaggtacagacagccgatgtgacagaaggggaaaacgtgacggcaggagcttcggaagcaacagcagaggcggctgcggacagtgtaatcgtaaccatgcccaccacctcggagccggaagcaggctttaatcccgtatacggctggggagccggcgagcatgtgcatgaaccgttgatccagagcacgcttaccaccactacggcagatttgaagatcggcaaagatctggcgacggattattccgtgagtgaggatggcctgacctggacggtttccataagagatgacgtaaaatttacggacggggagcctctgacagcttccgatgtggcttttacatataatctttgtgtggaaaacagcagtgtcaatgactttaccatgctgaaggaagcggtggcggtggatgataccacggtagaattccatatgaatacccccttttctatctggccttatacgatggcgatcgtaggaatcataccggagcatgcctatgatgaaaattacgggcagaatcccatcggttccgggcgttatatcatgaagcagtgggacaagggacagcaggtgatttttgaagcaaacccggattattatggggatgaagtgaagatgaaaaaggtcacagtcctttttatggatgaagacgcggcgcttgcagcggcaatggcaggacaggtggatgtggcccataccgccgcttcctatgcggatcaggttattgacggttacggccttctgcaggtggcgagtgtggataacagaggcatcaacctgccagtaggaccggtagaggaacgtgacggcctgacggtgggaaatgaagtgacagccgatattgcggtacgccgtgccattaacataggaatcgacagagaggaaatgatcacgaacgtgctgggcggctacggcacacctgcatacagcgtttgtgataaaatgccatggtataattcagaggctcaggtttcctatgatccggatggcgcaaagcagcttctggaggatgcaggatgggtgcctggggcggacggaatccgggaaaaggatggtgtccgggcggcgtttaccgtgatgtataacccgggggattccgtgcgtcaggcgctggcggaggatctggctaaccagtgtgcggagcttggaatcgaggtcactacagaaggcgcaggatgggacgtggcttatgataaggcattatcccagccccttgtatggggatggggcgctcatacgcccatggagctgtacaatatttaccacacgctgccggcaacgggaagcgcagaatattctccttacgccaacagtacggtggatgcctatatggatgaagcgctgaaggcctccgagctggaagattcctatgacctgtggcagaaagcccagtgggacggcagtaccggagtgacgcaggaaggggatattccctgggtatggctgtgcaatgtggatcatttatattatgtaagaaacggcctgcaggtggcggagcagaagatacatcctcacggacacggctggtcaattgtaaataacgtggatcaatgggagtggaacgaatagtgaagcataaccttcttatcagaaagacaggcagaaagttcataaggatgcttttgctgctgattacggtcagcatcgtgacctttaccctggtgagcatgtcgcccatcgatccgctgcaggccaatgtgggacaggccgcgctgggggccatgagccaggaacagaaggcaaagctggaggaatactggggggtgaatgtccccccggtccgccggtatctgaactgggcgggtggttttgtcaggggagatatggggatctcccttctttaccggcagccggtatcacaggtgatcggtgtaaagctgtcgaattcactgtttcttatggtatttgcctggctcatttcaggtattctgggacttgtccttggcatccttgcgggagttttccggggaacctgggcggatcggatcattaaggggtattcccttctcatatccagcaccccggttttctggctggctcttttgctgctgcttgtattcgcggtatggctgaaggtgctgcccatcgggctgagtgttcctatcggcgtagagagcgcaggcgtcacctttctggatcggctgcggcatgccatacttccggcggtcacgctcagcatcaccggagtggcgggggtgacgcttcatacgagagaaaaaatgattgatgtgatggaaagtgattacatgctgtttgccagagcaaggggggagagcacctggagcatggtaaaaaagcatggcctgagaaatatccttctgcctgccatgaccctgcagtttgcctccgtcagtgagattataggaggctccgttctggtggaacaggttttttcttatccggggctgggacaggcggcggtgacagcgggtacgggaagcgacgtccccctcctgctgggaatcaccattgtgacggcggctatcgtctttttcggcaatttcatcgcggatatcctttacggcgtcattgatccccggatgaggaagggaggggaggcgtcatgaaccagaggaagaaaaccatcctgatttttgcccttgcccttcttttcctgacttcggtgactttgtccggtatcttctgttatggaggtgcccggaaaacagacttttccgtaaaaaacctggcgccttgtctgcggtatccctttggtacggactggatgggacggaatatgctcgcccggacacttacaggactgtccataagcatccgcatcggcctgtgcaccgccgggatcagcgcgctgcttgccctgactctgggaatcatgtccgccgttcttgggaaaaaggtggatgcggttatttccttcctgatcgatacgattatgggaatccctcatatccttctgctgctccttatatcctatgcgttcggcaagggctttaagggcgtagtcctcggtgtggccctgacccactggccttctctggcaagggtaatccgcggagaagtgatgcagcttaaggaaagcgaatatatccggatcgcggcaaagctgggacagaacaggcttcagattgcctggcgccatatggttccgcatttgtttccccagtttgtggtggggctgatactgatgtttccccatgccatcctgcatgaggcgagtatcaccttccttggcttcgggctttcctctgagcagcctgctataggtatcattctgtcggaaagcatgcgttatctgattactggaaaatggtggctggccatgctgcccggactgatgctggtgctgacggtggttttgtttgatgtggcgggaaattccctgcgcaggattcttgatccttccagcgcacaggaataaggcagcagcttcataacggttcagcgggccggcgcatgtactgtgcggaacgcaggaaattgattccggggctgccatcggattaggaaagaaggcccgcaggcgggcaggagagtgaaaatgagctgtagtaataaatttcatattctggaaatccaggatttgtcaatatctttccgacaatatgaaaaagggatcagacaggtggatctgcctgttatttcccgtttgaatgtgacggtgcatgagggggaaatagtggcggtggtgggctcaagcggttccggaaaaagccttctggcccatgcgatcctgggcctgctgccttccaatgccatgtgcagcggagagttcttttttttacaggagccgcttacaccggaacgcatggaaaagctgcggggtaaggaaatcgcccttgtccctcagagcgtcacctatctggatccgctgatgaaggtgggaaaacaggtacggcgggggcgcagggacagggaaacggtcagccgtcagcgtgagttgttttcccaatatggcctggcacaggaggtggaggaaaaatatcctttcgcctgttccggcgggatgagcaggaggattctgctggcaacggcgcttatggaaaatccccggctgatcattgcggatgagccgactcccggtatggagctgtccctggcaggcaaggctatggaggacttccgcagatttgcggatatgggcaatggggttttgctgatcacgcatgatattgagctggccctgaaggtggcggacaggatagcggtattctatgcggggaccacagtggaagaggctcttgtaagcgattttgaatcggaagagcttcttcgccatccctatacaaaagccttatggagagccatgccgcggaatggtttccattccatagacggtgtgcagccttacgtaaaggatttgccgaagggctgtgttttcggtcccagatgccctgattttacacaggagtgcgaaggggaaatcccggaacgggtgatccgctgcggtacggtacgctgtatcaaatgcagggaggatcattcccaccatcatcacggagggaaggaggcacatgaacatgctggaagctgaagatattgttttttcctatacaaaagggcagaagccggtgcttgaccatataagcctttctgtcgggccggaggaacgggtagggatacttggcccgagcggatatggaaaaactacgctgatgaagatactggcaggctatcagaggcctgactccggcagggtgcttctggacgggaagccgctgccgaagagaggctactgtcccgtgcagatgatctggcagcatccggagagggcgatgaatccccgtcttaccctgggggaatccctgaaagaggcggataacatagaccggcagctggaaatcgggcttggcatcgaaccggactggaaaaccaggtatccgcaggaactgtccggaggggaactgcagcggttctgcatcgcgagagcgctggggcagagaaccagatatctgattgcggatgagatcagtaccatgctggatttgattacccagggacagatatggaattttcttatggaagaaacggccaggaggcagatagggatgctggtggtcagtcacagcaaggacctgctggattatatatgcaccaggcagataaggttataaagggtgtttgaaaatgccggaaaggaagaacaggatggatacacaggaaattttactgcagtttaaaaacgggcagatgtctttggaggaggcggagggctatctgaaaagacagccttttgaggaaatgggctatgccaaactggattcccacagaaagctgcgttccgggtttgcggaggtgattttctgcagccggaaagcggatgcccacctgctggagattttcaggaggctctatgaggaagagggagaagtgcttgggacaagagcctcccagcatcagtatgaactgctgaaaaaggaattcccccaggttcagtatgatgaaatttcccatattatcaagattgaaaaagagggaaagaagagaatcgggaagatagcggtatgtacggcagggacggcagatataccggtagcggaggaggccgctcagacagcggaattcttcggctccaatgtggaccgcatctatgatgtgggagtgagcggaatccaccggctgatgtccaggctggatgtgatacagagtgcgaattgtgtggtggccgtagccggaatggaaggggctttggccagcgtcataggcggccttgtgagcaatccggtgcttgcggttcccacgtcggtggggtacggtgccaatatgaacggactgtccgcccttttgaccatgatcaattcctgtgcaaatggaatagccgttctgaatattgataacggttatggagccgggtatatggcgacacaaataaacagacttgcggaaagggatgggaaccattctttcggagaggagacagaacatgagtaatacgctttatttggaatgcctttcaggcatcagcggggatatgaccgtggcggccttactggatttgggcgcggacaggcaggtgctggaaaaggcgctggacagcctgcctgtggatggcttttcgattgaaatcaagcgagtggtgaaatcggggctggatgtctgtgactttaatgttgtgttggataaggcgcatgagaatcatgatcatgatatggagtatctgcatgggaaggaagcgcctgagaatacgggactggaacacagccatgctcatgggcatggggcggaggggcatactcatagccatgaccatggggaagagggacatactcatgatcatgaccatggggaagagggacatactcacgatcataaccatggggaagagggacatgttcacagtcatgaccatggggaagaggagcattcccatgtccatgtagtggaagagcatgttcatttccacgaccatgatacggcggagcatattcattcccatagtcatgcgacagcggaaatttcccatatccatggggaagaggaacatcatcatccccatgagcacaggggactcaaagaaatccttcatatcatcagccatgcacagataacggacagggcgaaagaaattgcaaaccgtatttttcagattctggcggaagcggaatccgcggctcacggagtacccgcagaagaagtgcatttccatgaggtgggagctgtggactccatcgtggatatcgtagccgctgcggtctgcctggacaatctggatatcgatcaggtcattgtgccgaagctgtgtgaaggcagcggctttgtacgctgccagcatggcacgatacccgtgccggttccggctgtagccaatattgccggaagacatggcttaaagcttcagatcaccgatgtgcagggagaactggtaacccctacgggcgccgccattgtcgccgcggtgaaaacggcagataccctgcccgaaacctttacaatactccggacaggcatgggtgcgggcaaacgcagctatgagaggccgagtcttctcagggccatgctcatacgcagtgaggcaagggaaagtgacaccatctgcaagctggaaaccaatatagatgactgtaccggtgaaatgatggggtatgtcatggagctgctttttgaagcgggagccagagacgttcattatatgccggtatttatgaagaaaaacaggccggcttatcagctgaatgtcatctgcagggaagaagatgcgcataagctggaggatattatattccgggaaacaaccaccataggaatccgccggtgccatatggacaggacggttttaaaacgggaaatgcttcaggtgtccacagaactgggccaggcagcggtaaaggtatgctatctggaggatcaggtccgttattatccggaatacagcagtgtgacggagctttgcagaaagcacaaccgcccgttccaggaggtttatgcgataatacaggaagaatgcagaaagcatcagaaatgaaaagccgccggcgaaacagcttataatgaagggaagaagcatatggaacctacaggaaagaaaaaagaagaactttgcgctctcatggataaactggcggcggaagatattatggttgcattttcaggaggtgtggacagcagtcttttattgaaggctgcctgtgacagcaccggaaaaaccgggaaaaaggtttatgccgcgaccgtgcagacccagcttcatccctccggcgatatggaagtggcaaagagagtagccggggaaatgggagcctcccatattgtgctggaaattgatgaactggcggaggccggaatagggaataatcccacagacagatgctaccgctgcaaaaaatttctgtttcaaaaaatgaaacaggaagcgcagaagctgggagtaccggttatcgtggaaggaaccaatgaggatgatcttcacgtgtaccgtcccgggatcagggcaatcagggaactggggattgccagtcctctggctgaactgggaattaccaaggcacaggtgcgtgaaatagccgccgactatgggatatcggtttccgagcgaccctccgccccctgcctggccacccgttttccctatggtacgcagctggatatggctgaaatggaaaaagtggacgaaggagaaagttatctcaagagcctgggcctttataatgtacgcatccgtgtccatggagaagtggcaagaattgaagtggataaaaaagatatggcggcagtgatggaacacaggatggaaattgttacggctctggaaaacctgggttttgtatatgttacactggatctgaagggatttcgttctggcagcatggacgtaggcctgaatgtctgaaaattttttgatataaaataataaagaatgaaggcagagaaatggacagaagcgaaaaaacagtattgactaatatgtgtatgatatacgatgatgacggtaacgtgcttgtgcaggacagaagggacagtgactggggagggataacctttcccggcggtcatgtggaaaaaggtgagtcctttacggatgcggtgatacgtgaagtttacgaggaaacaggcctgacaattgaaacaccgcaaatctgcgggatcaaacaatggccggaggatgacggaagccgttatatagtgctcttttataaaaccagccattttgcgggcgaactgaaatcttcagaagagggtgaggtatactggacaaaactgtcccggctgaaggatcttcctcttgcaagggggatggaacttatgcttcgggtattccttgaggacgaggtcagtgaatattatatctatgaagaagatggggaatggaagcatgtattgaagtgatgtgccagcggacagacattagagaggtgccgttattgaaaaatataattattgtaggtcccagcagagccggaaaaaccacattggcgaaaaggataaatgaggagctgaattatttcgtaatcagtctcgataaactggtcgctgtatttggaagggcatatccggagttagatatcaggcttgcctgggatcgtgagaaaaccacggcaaatattgctccgttccttggtcatttccttggtatgttttcttcaggccatggcgctgcagatgatttaaacctgcgggcacacgctgtagaaggcaatcgatttgttctggaaggaggatattttgattttgagaagatatcatctgttctgaaattgtatggaattgaaaatctgaaagacaattttatactcatagggctggtgcaaaacaaaaaaacggccgatgaattcttcgacgatttgaggaaatatgatacggaagacgattggacatatggttttgaggacgatgaactaagagagtatgtcagtcaggatgccatcccgttcggacgagttatgacggagcagttgagaaactatggatttaagatttatgatacatctgtggggagagagcgggtttttaagcagattatagaagatattagggcggaaataatgtaatccatgcagtagttaatgcactgagggtattatcaattataattataaaagataaataaatttgtctgcttgtattggcagacaacagagagggtgaaagcgataaaagctttcgccctcttgccttttcctattcgggattgtggatgtactccacccatttcaccaaagagtaatacagcataactaatgccgctgaaagcaaaatggccgcagcgatgtcagtgaaccaatgaactcccgacagcagccttcctatgatcgtaactgcaattattaaaacggaaaagacgtctgatgctataagcagtcgtttcctgctgttgtgaagctgctggtggaattgcagcattgcggaagccatgatgcatattgtaatcattgtatgcgaggatggataggacgcttccagttccgagtccataagaacaggtctgtaattaataatgacaaactcaaagaaaatataaaaggcaataacaaggatatacaaagcccctaataacaaaagatggaaatcaacttttgatatactttttcctttaataaactggcaaagtcctgaaatggcaaaaccaaccgcaaatattatggcgataactccaagcagattagtgatgttataccatatggaattcgcacctaaatggttaaacaggaattgatttatggaagcgagccctatttcggattggtttggcccgacaggttttacatcaacggttttcattattattgtaaagagtataaaaagcagaaataaagagcctgtcaggatgaaaagtcttttttgtctttttggcatagtaatgttcctttcattagttgtgataaattgcttgcagcctgcatgcagattatccgtcaacgtgtaagaaaggacaagaaaccaaatgtcacaattggcaaaaggccctgatacttttcgtaacaatggcctttttaagcgggttttgaaccaattagttcagtttgctgcttttaatcaggagaataaccttgatcataaaaaacaggaaaagcagaaccgttgcatatggctgacgggtagcagtgaagacaataatagaaaaggcctgcaggaaaacagagcagtttctcataatgcgcgttcctttttcatatgaaaaataagaagcaatcagctgtacaatacccataattgccataagaatcggaaagataaaataaattgtccatgtcaggacattcgcatcagggtttgaaaacagactcaccatacgaatcatgttttcattctgctgtccataaagtggaagaaacaaaaaaacaagcatcataaaatccaaaatggcataaataagagtgaaaaatttattcatattagccaggttttcgtctgcggcgagagaaatcagttcttccccggacagtaaatcatcaatggttaccgaaaaaagcctggatatacttttcaatgattctatattcggataacccttgccgctttcccatttggatacagcggttcttgacacataaagtttttcggcaagctgttcctgagtcatattattctgtttacggagcagctgcagcttttcgttaaattccattttaatgtccctttcgatttaaatgtgacggtaatacgtcagctttggtcgatgcatatatgctattatatagggacagaagaataatgacaatataagcagaaaaatacccgaccggatatgctcgcaaaaaggaaacatacctggccgggcaataaagtccgaagccatccacagccgctgcatacggcgatacctcctaagataccgccgtatccttaaaaagggcagctttaatacacccaccatgttttactttagcaaaaactttcggcgttttttatcaattaacaatatcagcataatggctgctatctgtaaagcataaacaacaagcgtttttacgcttggagaattgttcaaagaagtgagtgtatacattccacctaaaacggtgttcccccaagcatggattaagattgttacccaaatgcattttgtcagccgataggcagccgcaagggtcaatcccaagataatacaatacagggtaaaggcaataaagttcatatctccctgtgtggagtttggtatgaaccacagtggcaaatgccaaactccccaaatcacaccctcaataaatgcagctgctaaaaacgaaaaccgtttttcaagcaaaggctgaaaaacaccccgccaaccgatttcctctaagcccccgccccaaatcatcataggtataaagaggataaataaataccacggattgcccaaatagctttcctgtacgatacaagcggcaaattgaatcgccgcgaatagcagcaaaaagataatgcttcttcgcatattggacgtatgaaaaacctgcttgcaaaacgcttttagtttaatgcctgtttgctttctttgcacgataaaggcggcataagcgggagccattcccgccccaaagccgattgctgtaaaatagagaaaaagagtaatgttttcacttaacagattgaaacgatacaacataatcagcaaaaattctgttccccatgcgattgcaaaggtataaaacaaataacgccgcatcatactcaattcttcttttgagataaaatttctttgactcataataataagctctcctttgtcactatatttccatgcgctttactttgtgggagacattaagagtgagcagaatacctccaatcagagccgctgctgcgagaaataaaactggcagaaactgctcgttgattgccgctacaggatttatcaaaagcatacttagtataacagcggaaataatggttacagaatttgactttttgataaagccgattcggatagcgcataacgctataccgtccgcaaggcacaccaataccaaagcgtttctaaacgctaacatgaaatcgcccggtaccagggtatcatttaccatttggagaacggaatctgtcccgataaaaatcagaaagccgccatattcagtcaagaacattgcggtgctgatgaaaagcaaaattaccgccgcttttgcccatacaacagatttgcgatttatgggatagctgaataagaggattgcacccacgccgcagtattcttttgtcaaatagcgatagcccatagcagaggccaatatcgaaaaagacatcaaagcgatcgcattacagattgccgcgattccttgataggtggagaataggatagctgcatttttgtctcctgaatccaaatgcggcacccatgcaagtatgtatgtcagccccataatgcacacgaatacggcaatagcagaaagaaaataaggttttatgtttgtctttttcagctctaatttcagtatgttcatgcttctgcacctccgctcataatctgaaagaaatattcctccaagccgttcgggtattgtttcttgatttcgcatatagccacctcttgcgcaatgtttccattcgtaagaacgccaaccacatccgcaatatgctcaatctcgctcagaatatggcttgaaataaggagtgtcatgccgtcttttgccagagataagaacaaatttcgtatttgccggattcccatagggtcaagcccgttgattggctcgtctaaaatcaaaatttgcggagagtggctgattgcccgtccgatagcaagccgttgtttcattccaagagaaaatttagaaacaggctgctttcctgtatcgccaagccccaccatttctaatacttgcccgattttctcaaagctgtgttccatgtaacttaaatgaatttccaagttctcttttgcggataaatggtcataaaagacgggcgtttcaatcaaaatccccatttttttcaggaagtcttttttgtcaatcgataatgtttccccctgcacttttatgtttccggcggtcggggacagcaagcctgtgattaacttaaacatggtggtcttgcctgcgccgtttgcaccaagaagtccgtaaatcgtgccgctttgcacggttagattacagccccgcaaaacctccttgccgtcaaatacctttgtcaaattacgaatttccactgctgtattcgtcataatggttgcttcctcctaattttataagtatcttttttgagcgcacggcaatcaccagggatatcatacttgcgccgatgataatgacaggttggctcggcaggcactcaaacagaaaaccatacaaaagctgtccgattggctgaacgcacatgataaaagtcatgatacaggcaaccaccttgccgattaaatgctgcggggtttctgcctgtacaacagccagcatttgtatgctgaacatggttgtaaagatagttactgaaagccccgtgaccgacagaatgacatattttatcatgggtgattgaccaattgccattccaaaccccataaggcaactacaggcagtacaaagaaaaagcggaacgtatgctgtttggggcgtaagttttttatccaaaagcaccgtcagcaacccacctaaaataccgccaactgcaagcattccttgcgtaagtccaagcagcccgtctgtcaaatgcagcttgtcaacgacaataacaggaattcctattgtcagcatgggggatagaaacaggtttagccctgctattacaatgcagatctgaacaaacagcggcttttccattctcaaaaaacgtatgctgtcccgtagatcacctgctgcgatttgaagtaccttatcctgtgtcggctgtttttggaacggtatcttgataaaaatctccatgacagcggacaatacaaagcatagaacgctaacctttaaaataatcacaattccaaacgctccgtaaagcataccgccgataatcgggccgataaagtttgcaagtgccccgatttgattcacgattgcatttgcagacagtatcttttcctttggaacaagtgcgggaatactcgcctgtactgcgggctgataagtgccggaaataccgtaaagcagcatgagtacggttataaacagcggtattatggggactattcccaagagccatgaaaataccgtaatgacacccgccgtcagaaaatctaaacagaccataatatttcgtttgttcacacgatcagccagtaccccgcccaaaagtgacaacacaatcatgggcaaaaaagaacaggctgtcacaatgccaaacaaagttgatgaccctgtttcccttaataaatataatggcaaggaaaaacgcaggattgcattgccaaatagcgatactatctgaccgacaaccacaagcgtaaaatccttgccatacttttttgtgttattcatcatagccacctccctttaccaataagtctaagggtggtggtaacccccaagtcaacaggggatttttctttatttcaaagggataaacacctcgtaaaaattgcgctctgtatgccctgaaagctcaacaaaacgaatgaaaatatagacgacgcctttgaaggattctttatgttcttctgcccagccataggcggcaaaaaacattttttccataatggaatcgtcgtgactgtctgcttccaatacagtatgcagacatttaccgctttcaagatatgttttttctccggcttgcactttttttacagcacgccttacaaggcacatctttgtccctttatatccggtttggtcaaaggtaacggcacgaacaagacttgataaaatatcgtcctcctgcaaatccatgaacgcaagcactctgtccttgtaatcattaagggaggatacggcatcaaaagtttcaagcaccaaatataacggcagctctttcaccgtgaataacttagacgaaagggcagtatactcacaaaaaccctttgtttcggcaagacgttttagaatacgctgctgtatgcggatattattttcaatctcgcttatttttctgcttaacgaggtaataccgtcacgctccccggattccataagttcttttatttcaagcggcgtaaaaccgcgcttcttgtaaaaatcaatggacattaagcgggaaacgtcctcaaaggtaaattcacggtattggctgtttcggtttctttgtggctctatcagcccgatttcctcgtaatagcgcagtgtttccctcgtaagtccgaggtttttataaatatcattggcacgataaacagtattgttctctgaatccatgcggttaattttatgtagttctccctgcaattcggggttatcaccaacgataactttgtttgtagaaaaccgattgtccacaggtttttcagcgtgcgcgggtattagccatgttttgccctttttcattgcccctgcaatttttcctgccttgcagtagtaagccaccatgcggcttgaaacattccatatttgtgccatttcattggctgttaaataatccattttgtttccctcctacagccattatatttcgtatatctgaaatttacaagattatgcattttgactattttaataatatgctctattactgttcatactatgaaatgtgtgctcatatccaaatgcatagggtgggaatgaggcgttatcaagaggaacaatgacagcattttgcggcaggacagagagccggaacggggaaaggaagttgaacgatagaatatttacttatgaatagctttttcgtagcagggacagaaggtgtttattgcccgaccggatatgctttccaaaagtcagcatacctggccgggcaataaagtccggaagtgttataataatttacaggaatttcactctggtttcatcataaaaacctctggcagcaggttcttcatccgcttccccaacagcaatgactgccagtggctggctggtaacagaaaggatctcctgcagctcctttacacgctccataaccggatagcagccgcaccagcaggtgccgtaacccagttcttttgcctgaagaagcaggttctgaatagcagcgccgcagtcctggggccagaaaccggcgcagacagattcctgaaggtcaggcctgccgcagacaacgatagccagggaagcggttttcagcatctgagtgtaaggatgagacttcataatctgttccctgatttcctctgtttccaccacaacaaattcccagggacgggtattgcaggcactgggcgccatcatggcggcttccagcatctgatggatatgctccttaggaatcactgttccttttttgtatttccgtatacttcttcttgcacgtattgcttctgatgtgttcataaatgctcctccttttccagtttttcggatatttatattgtaagttgtaaattgaaattattcaaggaaatatttatttattattgtaaaagcaataaaactgaaaactaatcgttcagaagaaattgtcaaattgcccgtttgggtttctaaacttgatgtgccgttatccagcttacgagttcttcaaaagaacatttatctgatgctacattgaggataattgtatagagttctttttgagtatattctaattctataccgtttaaagccagaaacatcagcatggcatgtgcaccaattcttttattgccatctatcatggcatgatttttgattaaaccataacctaatctggctgcttttaattgaatggtggggaataattcttgaccgctgaattcttgaaaaggagcagccagtgcagaatccaataaagcattatctctaattccatcactgccaccggtctgtctaatcaattctgtgtgcatgaatattatttgttgtttggacaatataatcatttagcaagaacctcataagcttccttgtttgcctccatcagttttcttgaaagcgccattactgattcatcagaagcattttcttgattatcagccttgacaaactctattaccaaatatttgggcacattgttcttcataattactgctgaccccagttcgtcaacaagtcttgcaactttagaaaaattttgatttgcttccgtaatagaaacaatactttttgtatcaattatcataataataccccttttctttttattatactataaattatacaatttattcaacctattattcgttgtaagaataaaaactttataaaataatctttcatgaatatttagggcatatcgaaagaatggcttaaaaataagggtttccgcatattgcattatatcttgtaatgcctgtcatatcatggtttgataaagtgaaacaacaacaaaattaagggggacgaaatgaacagggtattatattcctatccggcgtaatcaacaaagacaagataaatcttgtcatcgtggcaatcatgtagtctcctgaggaaatggtatgcttgatgacaggcggcgacatggaaaccataaaacgattgacgtacagacgtcatttctcctgtccatatggaaagataggaacatcgctatttttataacatcatgttatgtcttttcctttaaaagcctctgtctgcttcgtaacaaatctacagcatcctcctccaatccttccttttcccccataaatccgcctaaaatcacaaggaatcccccttcccacaaaaatcctttccctgcatttcgcaagaattcacagccatggcaagtataaaatcttggatatataaaataccttcgctattatgtaatcaagttaacaaaacgactacatcttatgagaagggaaggtagaagatggctaagacgaagaaagaaaaatggagcctgagacaggatttccgaaaaagatggcagctgtatcttatgctgctgcttccggttctgtacatcctgatattctgttatgtaccgatgggaggtattataatttcctttaaggattactccttcaggaagggaattcttgggagcccgtgggtgggactgaagtatttcaaacagtttttcggaagccccgatatcggaatgcttcttaagaatacgttaatcatcagcttttaccagctgattgttacattcccggcgccgattatcctggcactggctttacatattataggaaatgaccggtttaaaaagttcatgcagaccgttacctatgctccttattttatatccacagtagttctggtaggtattgtactgcagtgtctgcatctgaatatcggtattgttaataccattctggaattcctgggtatgaaccgggtggactttatgggcagagtatcttacttccgtcatatatatgtctggtccggtgtatggcagacaacaggtttttccgctattatatatatcgcggcactgggcaatgtggatcagtccctggtggaagcatccctgattgacggggcaaaccgtctgcagagaatccgtattgtagagcttccggccctgaagccgattatcaccattcagctgattatggcaatcggaagtattatgggagtgggctttgataaaatctacctcatgcagaatactttgaacctgccggtatccgaaattatttccacctacgtatttaagcgtggtatgaaggatctgcagtattcctttgccacagcagtgggactgtttaattcggtagtcaattttatactcttgttcaccgccaataagctttcccagaagtttggcgaaacaagtttgtggtaggaggagaggaaatgagtacaacggcaaaaagcaggaaaaatcccaaaaataaagtaaagctttatcacagtcttccggacaggatacttaccgcatccgtgtgggtactgctgataataataatgatagttatcctggttcccctcatgtttatcctggcatcttcattcagtgatcccagtgcagtttcctcaggcaaggtatttttatggccggtggatttctcgctggtagggtataaggctattttccagtcacccagtatcctgcgtggttttatcaattccgtggaatatacgctggtgggaacgattatcagtgttacgctgactctgttcgccggttatcctctgtccagggtggatttgaaaatccgcgggccggtgatgtttctgttcacagtgaccatgtttttcagcggcggcatgatacctacttatctggtggtgagcaagctgcacctgatcgatacgttctgggctatggttattccttcggccatgggagtatggaacgttatcctcaccaagacctatatccagagttccattcctctggaaatttacgaaagtgcatccattgacggctgttccgactggaaatatttcacaagcatggttttccctctttccaaacctattatcgcggttatggtattgctgtatgcggtaggaaaatggaatgatttcttttcaggactgatttatctcaatgattccgccaagcagccgctgcagatgaccctgcgcaatatcctggtcatgagcgacagcttcggcattaatatgaatctggcggagcagatgaaccgccaggaactgaaaacgctgctgcagtattccctgattgtggtttcttccgttcccgtactgcttttgtatcctctgattcagaagcatttcgtgaaaggtatcatgatgggctccatcaagggctgatataggacaaacagacagaaaagataatacagattaacaggatgtttcactcaccgaaggcgagtatcactttttccggtgggttaatcataaaacaatgaaaaaatgggaggtagcgtatgaaacgcaaaaatttaggaaccaaacttgtggcggcaggccttacggcagccctgctcctcaccggatgcggcggaaattcatcttccggccaggcaacaggcagtacaggggaaggaacaacacagagcgccggggaagaggaacgccctacaattacggtagcagtatccatgaatgaaaagggagagtactccgacgccaattatgccatcaaatatattgaggagaatacaggcgtaaacattgaatttgtccagctgccctctgagaaggcggatgcggataccaagctgaacctgatgctgtccagcggggaatacccggatgttatctgctatggcatgaacaagcagaaaatggtgaaatttgcgaaggaaggaatttttgtccctatcaatgattacattgataagtatggcgataacatgaagagattgtttgaagccagaccgcagtatgaacagctttcttatgcgccggacggaaatatctacggctttgtaaccgcgaatgagtgttatcactgccaggcatatcccaagctctggtataacaccgaatggctggaggctctgggactggaagaaccccagaccacagaagaactgaaggacgttctgcttgcggtaaagaacagcgattataacggcaacggcaaagccgatgaaatcccgctgacaggaagcaaggattgggactgccagctggaatggtacctcctcaattcctttgtacctgttgataaggatactctctctcatgtagaagacggaaaagtggttttctcctgtaatacggaagagttcaagcagggtcttgcttacctgaatgagctgtacacacttggcctgattgaccctacctgctttacacagacctctgaccagatgcagcaggtgatccgttccgataaaaatctggtattcggctatacggcagatcatttcgccatgggtattgatttggatgatgctcatctgaatgaagtgaccgcggcaatgattcctgcggaaggccccaatggcgcaagatggcagcttcataaggattatgtggatatgaccgatggtttcagctggttcattaccgataaatgtgaaaatgtggaggcagccttcaaagttggtgatttccttatgggagatgaatcctccatggtacagatgtatggagaagaaggaaattactggggaaaactggatactcctacggaatccatccttcagggaaccgaagcagtttattggattaaacccggatttacttccaatgaagatgatgcttatcagaaaaacaccttctggtcaggcctgatgaaccagctggctgagttccgtgcttccatggctcccagaccggaggacatgtatgttccggattcctatgaagcaaggctttttgatgaaacagccaaagttgttccttatttctacccggaatacctgcctaaaaacctgttcctggaggatgatacggattcggaaacctttacaaccatccagacatccttaagagaatatgtaaaaacctctatcgcacagttcgcaaccggtgaaatgagcgtggaaaaggactgggattcctatctgaaagctctggaaaaatatgatgtggaaacatatgtgagcttatatcagaaagcatatgatgtatacgcagcacaacaataaccgaaataagaaaagggcgcgcttgaaaaggcgcgccttttccgaaaggaattgaactatgggaatgttaagtggagaatgggaagacaggctggcacattggatacgtaccttgaagcaggatttctatgaggaactgggtgaaatctcctgggaggcattccggacaaaagaaaagctttctccaaaagaactggagagcctggagctgctgccggtacagccgggctatacctggggagaatgctgggaatattgctggttcaggggaacgttccggcttccggaaaaggcgcagggacagcgtattgtcctcgatcttaagccgggaggagaatcctgtctgtttgtaaacggaagagaattcggaacctatcgtgcggactggattgaagaaccccatcactatatggtggataataccatttcccgctgtgctgatgcaggagatgtttatcagatctgcatggaaacctatgcgggacaggattttcccaactgtgaaacaggctattgtgccacagggcctgtcctgccgggaagcagctggagcagtctgacggagggaagcagacgtacgctcggcagatgtacctatgggatctggcgggaagaagcctatcagctgtacatggatgtatcgacgctttttaagctgctgaaggtgctggaggagagctctctgcgggcggcagaggcagcggaagcgctgaaggaattcacccgcattgttgattttgaacaggatggggatgcccgtctggcctgttaccgggaggcggcggatgccctgaagccggtaatggaggcggtaaacggaaccacagctcctttattctgggcaataggaaatgcacatctggatctggcctggctgtggccggtggaagaaacagaacggaaagcggagcggactttcgcagcccagctgcggcttctggaggaatatcccgaataccggtttatccagagccagccggccctgtatgaaatgtgccgcattcactatccggagttatttgaaaggatcagggatgcaattaaaaaggggaactggattgctgacggggccatgtgggtggagccggataccaatctcaccggaggagaatccctggtacgtcagctgctgcatggcaagaggtactataaggaggtcctgggggcggaaagcgatgtgctctggctgcctgatacctttggctattgcgcggcgcttccacaaatcctggcaggcttcggcgtaaaatatctggtgacacagaaaatattctggtgctgtaatgacggggaacgtttcccctatcattattttacatgggaggggatggacggaacaaaggtggtatccttcctgccgaccagctatacctaccggacggatccggaggagattggaaacgtgtggaagaacaggagccagaaggaggatctgaaggcgttcctgctgccctttggctatggagacggcggcggaggcccgtccagggatcatctggaatatatacgcaggcagcaggatctggaagggagccccagaatgaaaatgggttctccgaaggaattttttcatttcatggaagaacaggggggaccaagacacacctatacaggtgagctttatttcagctcccacagaggcacctacacttctcaggccaaaataaagaaatacaacagggcatgtgagctggccctgcgcgaaatggagtggtggagcgccctggcggggaagaagggcatggtatatgatcaaagccgtgcggacagtctctggaagctgcttttattccagcagttccacgatatccttcctggctcctctatcgcccgggtttatgaagaagcccggaaggcattcctcaggattctggaagaatcacaggaaatgctgggacaggcattggattttctgctggaggattccggagatgccggtacggttaccatttttaactccctttcttttcccagaaaggccctgataaccctgccggaagaattccggaatggtgcggtgacagaagatgggaaacgggtgtacgtgcagcatatggaggaaggatacaaggcgctggttgaactgcctgccggtaatggaatgacactttatgcagcagcggagaatgcagcaggacaagaggcgtctgacagtcagtacagaaaggcgtatgcggctgtgcgccggacggaaaccggatatgaaatggaaaacgacaggatttctgcccggatcaatgctctgggacaggtggattcctatgtcctgaaaagctcaggaagggaaatggcggcagggccgatgaaccggctgcgtttgtttaaggatattccgcggcattttgacgcctgggatatcgatgcgtgctatcgggacatggagcttgacggagtgagggatgttcggatggaaagaaaggcggaagggctggaggctgtattaaaggtctgcggaaaaataggaaattcttcctttacccagactataagcctggcggcagggcaggaacgccttgaattccatacccggatccactggcaggagcttcacaggcttttaaagacggcttttcctgtagaggtacatgcggaaacggcaagaaatgagatacagtttggttttgtggaaagacctgcacaccgttccagggaatacgacaaggatcggtttgaggtatgcaaccacagatatacggccctttgtgatgaggcccatggggcggccgtgctcaatgacgggaaatatggaatcagtatggaggaaaattccctggagctgaccctcctgcgtgcgccctccagccctcagatgagagcggataacggaatacaggaattcacctatgctttttatgcatgggaagggagcttcacggaaagcgatgtggtgcgccagggctatgagctgaatgtacagccgccggtaagaagcggcagactgccggagatggataccgtaaggaccgaccggaaaaatattatcgttgatacgatgaagcctgcggaagacggcagcacagatgtggtactgcgtctgtatgaggccgaaagagcggcagtttcagccaaaatacagctgcctgcatggtgcaggagggcattcctctgcgacatgatggaacaggcacagcaggagctttccatagaggagggaggtattactcttatgttccattcctttgaaataaaaacgatccggctacggtaaaaaactggctttctattatgatcggaaactgctataattgtcctgctgccgtgtgttcagttactgtttgggatgctgtgcagatatgccataagagggggccccgaatgaaatacaggaaagtatatatcaggttaattattacctatctggcaatttttttactgccattgatcataaatattgtgatgctggaaaatctggccgtgtccacccgggagaatatctgcgccagcgttcattccaacatggctcacaccatggatacgctggataacaatttcagggaaatcaatacgattacagcgagaatttcaggaaacagcaacatccgttatatagccacgcagatggacgaggaaggcaagaaaattgaaatttccaagataacctatgcccaggagtacatggccgccatgcagatccagacctttgtggaggaatattatgtgcttttccggaagccggatatggtcatttccccgaacagagtctatttataccaggattcctggaatgctttttttcagtatggagacatgtcctgggaggaatggaaggcgctgatgacaggccattataccggccatttattcccggaaaagaagaccaaacaaaacggtaccgtagaggacaggattctttttgtccagtcccttgtgacggacagcggggtaaaggggaacctgattttccccatccgttccgaagggatcaaaaatctgatgagggatgcttatatttcccaggatggctgggcatatcttctggacgagacgaatgaggagatcattctgacggtaccggcggcggacggaagctttgaaaaagtgccttcctctgtgctggataacggacaggaaatccaggaaatagaattgaacggaaagacggtggaggtcatacgcgttgattcggatcatctgggaatgacctatatttccgtgcttcccaaggaatatatcaccctgcagatcaatcgtgaccagcagaagctgatcctgctgatgacggcggtgctgtttgtaggcataggcagcatcctgctcgtttcctggaaaaggggaagaaggatagatggtatcctgcagatgctgttcagcatgggtgcggaggacaaggaatcgctgaaaggggacgaaatggagtatatttccaattccctgaagcagctgatcgataataataccgatttgcaggagagcattatccggcagaagcccgttaccaggtccctgcttctggagcgtctgcttcatggaggcgaaggggtgagcttacagagcctggaggattacgggataaatcttaagggtaagaggatgctggttatcgcctttctcgtgggcaggggggattccgcggatgtggagctttatgcgaaagaaaccgtagtctataagcaggtgctgcagcagagcctggattcactgcttgcaggggataagtatatgtgtgataccgatatggacagcagcgtcgtaatctgtaccatggaaggcggcttccagccggccaatgccggattccagaaaaagctggagaaaatcacggaaaccttctgggaggaattcggcgtcaaggtgcgtatcgcggtgagcaccatctgcagggaactgacggaaatcagcaaagcctatgaccaggtatgtgaaatgctgaccttcggcgattcctcaggaaagacggtggtattttatgaggattaccaggacagcaaggaattctactattttcccgtgacgctggaggagcgtcttgtgaatgcggtgcgtacgggaaatgcggaaagcatgcatgtccagctcagtgaagtgtatcaggtgaatgtgctttcccggaatatcagcccctccatgatgcatttcctggtgaatgatctgcagtgtgcggtgttcaaggcgctgcacagcctgaatgacagggttgagattgaggaagaggagatttaccgccagctggagcagctgaaccgggaaaatgatatcctcctgcggtttaaccatatcaacagcatgtttaaatatatctgcgatatggtgaaggcggtgaataaagaaagcagcagccgtcagatggaggagattgagcaatatatctgtgaccattatatggacagcgatatggggctgacgaagatatcggatgatttcggttacgcaagcacctatttttccaagctgttcaaggagctgttcggggaaaatttcgctacctatctggaaaagatgaggatcgaaaaggtatgcggccttttaaagaaaggctataccatggaaaaaattgcggagcagaccggatataacagcgtgtatgtgatgcgtaccgcttttaagcggataaagggaatgacgcctaatgagttccgcaagctgaatgaagaagaaacggagtaactgtgaaggtacggatcagttacgaaccggaataagaacaggaaaagggaacgtatatgaataaaaaaatggtgctggacaggatcccctgccagttttgtgaaggcccgttctggggaaatgggaaaatgggagcggtgctgtatgtacagaacggaaagctgtgtatctctgtggatcacgttggattatgggaacttagggaaacccttccggatatgccgaaggcggattttcaggagatactggcccacaagaaggaatttatcgcgggagatccccgctatgtggaacggaccgatattttcggagataatatcggaaggacgagactgccctcccttgccgtggaattgagcctgcccggcgagattgcctctttccttgcggaaacggatatgctggaagccggaaccgggctgcgcctggaaatgaaggatgggaaagtattcgaaggggaaatctggctggattcctgtgtcaatgtgctggggataacgctttatggagaaggggcgggagaactggaagtgaaagccctgggctgggatttggattccccccgcctgaagccccttaaggactggcattacgagccctgcatacagacggaagaaaacgggctggtcactgtcaggcagcatttcggcggcagccggagcgctgttttgagcgcggggagaagggaaacgaagtattccatggaagcacagcgttccaagaaagcccagtatgccatggaagcacagcgttccatggaagcccagcattccatggaagcacagcattccagggaagcggaaggcctgttcctggcagtgagcattgaaaccggtgatcagacggaagaagccgacatggcggcggccggaacaaaactggtgcaggattatctggataacagggattcctatctggaggcacatcgcctcgactggaaaaccttttgggacggtttcgccgtggaagtacccaatgaacgccttcaggaagcctttgaacaggagatgtacaagctttactgcaacgaaagggaggattcttctccggtgacgctgcagggggtatggaaccccaataaccggatgcctgcctggttcggggatctgcataatgatctgaatgtgcagtcctgctactggcccgcctataaaaccggaaatgtgaagctggttcggccgtatattgattattacagcaaagcggtgccccggtttatggaaagggcgtataagctgttcggcataaaggatgccatccacatccccacgatgatggccccggacggcacaggagctgcctccgagtggtgctactggaattcccttttagggccggaattatttgtggcggtggattttacatggttttatgagtacagccgggaggaggacactctgagggataagatttatccgtttattgaaaaggtgctccacctgtatcaggggattgctatagaaaaagaagacggctgtctgcacatcccttttaccacttcccctgaggtggacagggatggacatatgttcatggcggatgacgccacctttaccatttcctgtctccattacctgtgccggaaaatgaacggctatgcgcagaagctacagctggacggcgcttcatggcttgcctggagcgacaggctggttcctgtgaagacgaatgaaaaaggtctgccggtctatgccggagtggacgtatttgcatcccaccgccatttctgccatctgtatccgatttatccgctgtgtgaagaggcgcataacgagcttgcacagcgttccctggatacggccataaaccagggattcctggaatttgccgcattttcctgtccatacctgggcatcatggcggcgcgctgcggaaggggaaacatgtcccggaccatgctggagctgtactgtatggtattccgttcccggaattccttcacggtaaacggggatccttatcaaaatggaatcctgcgtatttccgataccaatgcaggagaaagctccgatgccttcactctggaatccggattcttcatcccgacagccctctgtgaaatgttcgtccaccgggcaaaggataccatctgggtgcagatgggaatgccggatgaatggaagacctgcagctgccggaaactggctgtggaaggcggacacaggatcacgtcggaaagagaagactattcgatccgccgcatacttctgaaggcgggctgtgaagaaacgctcaccctgcgctggaaagatgacactccggtgaagagggtgatgagaaacggcacggaaatggaaggctgcggacaaaagtccctcactctggaagtattgccgggagaggaatatgtgatagaatttgaataaggaaacagggaggattcagatgaaggatttgcatttaatttgtaatgcccacattgacccggtgtggctgtgggacatggaggaagggatctcagccgccatttccacctttcgtatggcagccgtattctgcgaggaatatgacggccttgtattcaaccataatgaagtggtggtttacaaatggatcgaagagatggaaccggagctttttacccggattcaggagctggtaaggaaaggaaagtggcatatcatgggcggctggtatctgcagcccgactgcaatatgcctggcggagaatcctttatccggcagatggaaaccggaagggaatatttccgggaaaaattcggaaaacagcccacaaccgccattaatttcgatcccttcggacacagcagggggctggtacagctcatggcaaaagccgggtttgactcctatcttttctgccgtccgggacaaggggactgccccctgccggcggatgatttcatctgggtgggcttcgacggctccgaaatcatggcccacagagcggatacatacggaaaccttatgggagaagccggtaaaaaggtggaagaatggatggatgcccagaacaggaagcctgaagaaaagcagccgctggcaggctgtatgctctggggtgtgggaaaccacggcggcggtccgtcccgggtggatctggaggaactgaaggcgctgaaggagcgcaccggcgaatggaatctgatccattccacgccggaggcttattttgcgcaaagacgtgaagccgcgaaggcggcaggcagagaagagccgagagtggaaagggatctgaattcctgggcggtaggctgctatacctcgcaaatccgggtgaagcaaaagcacagggaggcggaaggaacgctttctgccgtggaaaaaatgctgtcccaggcggccctcagaggactccttccctatcctgagaaggaactgaaggaagcccaggaatccctgctgtttagtgaattccacgatatcctgccgggttcttccatacagtctgtggaggaagcgagccttcagatgctggatcacagcctggaaatattaaattattggaagcgcagagcattttttgccttgctttccggagaaaagaaggcggaggaaggagaatatccgattctgatttataatcctcatccttttcctgtggaaggcattttttcctgcgatttccagcttgccaaccagaactggagtgaatcctattccctgcctgtcatcagcagggacggacagattctggaaagccaggtggagaaagaagcatgcaacatgaatctggactggcgcaaaagagtatcctttcacgcggtgctggacccctcctgcatgaaccgcttctcggcacggataacaatggtggataaaaagcccggaaatccggccaatttggaggaagagcatataaaagaggcctgccgttattccaacgacaggatccgtgtgaggatcaatccggaaacaggccttctggattcttacgaggtggacggggaggaatacctccgggaaggctccggcgccctggtggtgatgaagacggattgtgatccatgggggatgaacaggcacagctaccgggaagagctgggaagattccgtctgatgggaaaagaggaaggaagccgttattccggcacctccaatgaaaggcacggatcggcgggctgcctcatacccagcgtacgcattgtggaagacgggccggtaaaacgagtggtggaagcggtcatggaatacggtcattcccaggcatgcatccgttacatcctgcctgcaaggggaacgaagctccgggtggaaatccgtgtgaactgggcggaaaaaggcgctttcctgaaatgggaaattcctaccgttttgaaggaagcgataccgttcgcagagacagcctatggtgtgatggagcacagaagcgacggggaagaaaaggtgttccaccgctggtgcggcttctttgacaagaacaaaaagcgcgccctgactgtgattaaccagggaaactatggcgtggactttatggaaggcgccatgcgtatatccctcctgcattccgccgtatattccgcccacccgatcggagacaggcccctgcttgtccaggatcgtttcctcccctatatcgatcagggggaaagaagctttgcctttgaaatcaatggaggagacagtgaggaacgccgggaattcgtaacccgggaagctgtagtgttccaggaaaaacccatggcggtgccggctttcccttccggggaaggggaaaagggaaaccccgtgattctggtggataatccggcggtggttttgggcgctttccgcaaaggaacggcaaatgactgctatctgcttcgtttatatgaatcctcagggaaaaagcagacagccacagtaagccttcccgccctcaagctggagcttcccgttgccatgggagcctgcgaggtgaagacactccgtctggcggccgacggcagcaggctggaggaatgcggtatcttcggggaataaagaggtgaatctcaaaaaataaatgtaaaataattgaaaaaccccttgccctggacttcacttcaggtgatatgattgataaaaagagatacctgaaaggagaaatgggcatgggaatgacgaagaaagccagagattatcaggaaaaaatgggaaccgatatgctgtcggcgctgcttgaaaccgatccggaattcgcggaacgctttgcagactttgcttatgacgaggtggttaaccaggatgatttggacgactgcaccagaatgatggctgttctggccgcgctgctgggctgtcagggggcggaagctttccgggaaatggtacccgctgcattgaatatgggcgttacgcctgtgcagctgaaggaaatcgtttatcaggccgtggcttatctgggaatcggccgggtacttccctttctgtccatcgttaatgaaatactgagctccggaggaatccgccttcccctggaagggcaggcagaaaccacaatggatgaccgcctggaaaaaggaaatcaggtgcaggtggacatattcggggagcatatgaaggaattctggaaaaacgggccggaggaatccgcacatatcaaccgctggctggcagataactgcttcggggattattatacccggaacggcctggattaccgccggagagaaatgatcaccttctgtttcctggcggcccagggcggctgtgaaccccagctgaccagccatgccgcggccaatatgagaatcgggaatgataagcagttcctcattcaggtgctgtcccagtgcctgccctatatcgggtatccccgcagcctgaacgcgctgcgctgtgtggatgaggcggccaggcagagatagggagtataagaaaaaagagcatattcctcttttcctgctaacgagtggaaaaaatccaatatgtgttaagacgacatcttcatgagaaagctgtcgtctttttctataaagaaaaagatgcagatttcttataatgaaagaaaaagcaaaagaaggagcaggcggggatggaatattatgcggaagtaaaagtaatgggggatgcatatggcggaggcttttccaatggactgaccatgtgcgggagtcagtcagcggcagctttccataaagtggaggacaggggggaggatgctgtgtatgacgatgacaggcagcatcgtattgtgcttcataaaaaaacagttggacaggctgtggaagtaagtacggaatttatgaatgacagccctgaagctgttacgctggaaatgctgtcatcatttgctgtcagggggatttctgcggacagaatacacaggctgcagtcgttttggagtgcggaaggaaaattgagaacggaaaccatagaagagctgcatctggaaccatcatggaaccgctgtgggatgagggtggagaaattcgggaatgttggctccatgccggtgcgtaagtatttcccctttctggctgcggaagacagcaaaagacaggaatttttaggcattcagctatattgcccttcatcctggcagattgagctgttatgtaaagaggatgatacacttaccatagccggcgggattgcggacagggattttggacactggacaaaaaaagtaggccccggagaaaggttcgaaacgccaaaggctgtgattgcccggggaaaaacactgtatgaagtgtgcgataagcttgttaaggcacagaaaccggcgatttcagaaaccgataaaaaaatggggatcatttttaatgagtattgtaccacatggggaaatccgagttacgataatataaaaaagatatgtgataagctgaaaggaaaaggtatccaatatcttgtcattgacgcaggctggtatggaaaaggccagggctggtggaacagtatgggagactggagtgtcaatgaggacaaatttcccgggggcttgaaaaaaattgcggattatatacgttcctgcgggatgattcccgggctatggtttgaattggagtccgtaggcaccaattccgggcattatcaggataaggagcatctgcttttaaaggacggagtaccgttaactgtaggggaacgccgcttttgggatatggaagatgaatgggtgatcagctatctcggagagaaggttattaagctgctgaaggaatgcgggttcggttatctgaaggtggactataatgataccattggcatgggatgcgacgggccggagagcctgggagaaaatcttcggaaaaaggtacaggcaacacaaggatttttcaggaagataaaagcggagataccggaaatcgttatagaaaactgttccagcggaggccacaggttagagccttccatgatggagctggtatcccaggcaagcttttccgatgcccatgaaacgttggcgattcctcttatcgcggccaatatgcatcgggtgatacgtccggaacagagccagatttgggcggttttacatgccggggacagtgacagtagaatcttttattccattgccagcacttttctgggaagaatgtgcctgagcggtgatatttatgacttatcggaggcacagtggagtcttgtggagcagggaatgcagttttatgaaatggcttcggatattatccgcagcggcgtcactgtaaggtgtgaatatagcaccgcacagtacaatcatcctacgggttcgcaattggttatcaggcagctgggcagccgctgcctggcagttctgcaccgttttgaaaactcggaggctgcggacctggagtttctcaggaacggcagaataatcgcggagtatggaagcgctgaggaggattttagcgcaaaggcttggatttacgaagtttgcaattgattgtcctctttttaaagttttctgaaattccttcttgactctctcactatggtatactctatactacaaatgagctcaggaaacacaagtacacatgcatgtgagggaaacgaaatgttaaaaataggtgatttttcaaaactgtcaagaatcagtatccgtatgcttcggcattatgatgaacatggcctgctgacaccggcttcgatcgatcccatgacgggataccgctattacggtgaagatcagctgatggaagcggagcggatccaggccctgaagggtatgggctttgccctttccattatccgcgaaatccttgaaaaatatgaggaaccggaggaaatggagcgcttccttctgataaaaaagaaggaactggaagaggagtcattggaaacgcagcaaaggatacgtcttcttgaaaacacccttcgttggttgagaaaggacggaaaacttatgaattatgatgtggtattaaaaaccctgccggaaagatatgtggcaagtctgaggaagattatccccgcttacaatcaggaaagtatactgtggcagcagctgaatgaggagatggcgcctcaaaatgtgaagcccgccgctccctgctacggtatggcaatcttccatgatgaaggctataaagaaagtgatgtggatgtggaaatccagatagcggttacaggtacctataaggataccgcaaacgtaaaattcaagaaagtggagccggttcagatcgcatccgcaacctatcagggcagctatgaccagataacaaaggtaaacgaggcggtagcggcatggatcaatgataacggttatgaatttaacggggcatccttctgtatttatcatgtgagtcccgcacaggcatccagccaggaagaccttgtgacagaagtctgctatccggtgaaaaaaagaggttaacactgcccggcaaaagaaacagacatgggcccataattacagacggccgcactgcatggaataagcagtgcggcctgcacttattccggtgtaacggaaggcagtgtccccagattattgctttccgtatcatccggaagagatttcagatattccgtatccttccgatgggcgattcccacccctttgatttctccatcctttgccagagccacgccgtcttccttagacaccgtagaaccatcagataactgataaccggtaatccgtccgctgctcttcacaagccccacaatatccttggcgtcatccttaggtgtgggaatactatccaaagcgattctggccaatgccgaatcaggtatatcatttctgtccataatcttaagtatcctttcctttattatttcctgtaattttattcaccgcaaagtatttttcctttttttgccgggcttcgaaccgcatttcctgcggtaaccgccgtccgacataaaatagtatctaacataggctaaaaagttattcagataactgacgaaatgtgttatcataatgttttcagaagaaaaaatgccgttaaggcggaaagagggagagctgatatgacaagtgagtttgggatggcggttcatgcgctgacctttttaaaccataagggggaaattgtttccagtgaagcgctggcaaaaaatatctgcaccaatccggcgcgggtccgcaaggtcatggcgaagctgaaaaaagccggactggttgatacgaaggaagggttggaaggcggttatcttttttcaaaggatgcacagaaggtagatctttccatggtggcggatgcgctggagaccagattcgtttccacctcatggaaaagcggaaatccggatatggattgtctggtggcatccggaatggcgggcctgctggatgggatttatgatgatctggattctttatgctataaaaggctgaaggggatcaccatagaagatattaatgaaaagattttcgggccggataagggctgaccggctgcaggcataaggagggaaggggaatgcgcgtttctagggcatcggaggaaagaaggcaggagatattggacgcggcgatgcaggtgttttatttaaagggctatgaaaaggcgactatcagagatatcgcgctggacataggagttgcgcaggggttgatatacagatattttaaatctaaggaagcattgtttgcggcggcgctggataattatgcagagcggctggccggggaaatggggcaggaaatcagaaatgatgagaccgggctccgggataaaatattgaatacaccgtctttctatcacattgaagatgatgacagctattattataagatgctgaacggtccggacagcaagggaatttaccagcagctttccctgaaggttgcggaaaggcttgttcccattgtgagggatgccattgcaggtgatcttgataagggcaggctgacctgtgtggaggatccggaaacagtggcggctttttgtgtatacggacagctgggagttcttttccgggaggatctgagcggaaaccagaaggtggatcggatcaggaaatttgtatcaaatcagatatgttaaaatgatttgccggcggaaggatccaaaaggcatcttacatatgcaggtctttatgaatataaaagatatttggaggtttttatgagtgacggacaacataaaaacggtaattttacatcgacaataggtttcgtgatcgcctgtgtcggttcggcggtggggctgggaaatatatggatgttcccctatcgtctgggacaatacgggggagctgcttttctgataccgtatcttctctttattttcctgtttggctgggtggggctgtctgctgaatttgccatcgggagaaaagcccggacgggaacgataggctcctatggctactgtttcgcggagagaaaaaaagaaaagctggggaaagcgctgggctggtttcccctgttgggatccctggggattgccatcggttattccatcgttttaggctgggtgctccgttccctggcgggcgccgttacgggaagcctgtttgaaaaggacgcggcggcttatttcgcggaggcggccggggctttcggaagcgttccctggcatttgattattgtggcggcggtaacgcttgtcctgcttacaggggtgacaaaagggattgaaaaggtgagcaaggtaatgatgcctctgtttttccttttgtttataattcttgcggtgcgggtggcctttcttcccggcgcttcagagggctatgaatttctgtttgtgccgaaatgggaagcgctgctgcgggtggatacctgggtgatggccatgggacaggcttttttctcactgtcgattaccggttccggcatgattgtatacggtgcatatctggataacaaggtggatatacccggcgcttccatccggacagccctgtttgatacgctggcggccctgctttccggacttgccatcatgcctgcggtatttgctttcggtatcgatgcgggcagcggcccgtcgttgatttttatcacgcttcccggggtatttaaccagatgcccatgggaaggctttttgccgttttctttttcctgtcggtaacctttgccggtatcacctctcttatcattatgtttgaggccgtgattgagagctggcagacacagttttctatttcgcgcaccatgtcggcgctgctcgtgggaggaatcaccttcctggcaggcgtgttcctggaggaggaaagccggaccgggaaatggctggatgcggtttccatcggcattgtgccattgggagcggttctgggagccgtatccatctactatgtccttggctatccgcggatccgggaggaactggagaaggggcacaaaggcaggctttccgccgcatttggctttgccgcgaaatatatttacgtgccgctgaccatcctggtacttatccttggttatgtatataacggaatcggataaagaagagagcatggctgaacggtaactcaaaaatcgtcattaaaggaaggggattgccgtgaagattactatattaacagaaaatacggtgagcagaagagggcttctggcggagcatgggctttctgtcctgatagaagccgggaacagacggatattatttgataccggacagagcggcgtttatctgcacaatgcccaaaagctggggatcagcctggaaggccttgacgggatcgtactcagccacggccactatgatcatgcgggaggccttccggaatttcctgccgcggcggactgcccggtattcctgagtgaaaaggcgctggaggataaatggtgcctggaaaagaacggcggcccggcacgctgtatcggcataccctggagggaagaaagcggagacggtcagatacccggaaggcttacctttacggcggaaaaggaagaaatttttcctgatatttatgtgctcggcgggataacctccaccgttccggaagaagccgcgcgggacaatctgttccgcatccgcagggacgggcagttcatacccgaccggatggaggatgagcagcttttgatcctgcgtacggcacgcggtctggctgtttttgcaggctgtgcccatgcggggatcctaagctgcctggagaaggtaaggacatcctttcccggagaaaaatgctttttccttttggctggtatgcatctgcgcggctgcggggaagagcaggtgaatgctgtcattgacggcctgaagcaatatggtttttccattctgattcccctgcactgcacgggaaccctggcgacagcccggatgaggatggccttcggcagaagctgcctcatggcggaagccggaaaaagctttctcatcccggaagaagagacagaaaaccggccccgaggatgagaaggaaaccggccccggtgcacagggcaatatgattcatatccagactgaagtcgatacctgacttcagtctttttattttactcaggacttttttgtaaaaaaggatggcgagcaggaagcttcccgcccagatcagggatttcaccagatatccggaaagcccaacggaaaagtccatttggaaaaacagggataaaaagggacctgcaaacaggccggtagccaggcagagcaggcttaacaaagcgagcacgagcgtggagaagaaattacgggtataggtaagctccttcttttccccgaaaagcatattcccaaacttcacaaaggacagaattgtgccgaaattgatgatcagaaaacagaaatccacgacggagttatctgttttggacagcatatatttggagatgctgccgttgaaaaaaggagctccggtaattcccaggatacccgcaaggacggccataccggcagccggcatgcttttcatgacgccgcggattttatatacattccgggtgccgtaggcggtgatgagaagcccggcagccaggaaaagcagggatttgaataatgcatggttgatgatatgcagcatggcgccgaagcgggataccggattggaggtggaaagccccgcaatgatcaggcccacctgggagatggtatggtaggccagaatcagcttgatatcgcactgacagaccgccatgacgatacccgccagcgcggtgacgacccctgcccagaagaaaaaggcatccatatcgaagaccggcgaaaaaacggcctgcaggcggataaacaggtaaaccccgcttttgatatagaggccggagagaatggcggatacggcagtgggagctccgggagtcccatgggcggcgggaagccagaaatgcatggggaacagcgcgcacttcatgctgactcccgtcataaggaacacataggccagaagcagctcctgcggcgtccggtaagccgccgccgctgcgagcccgtcaaaatccagcaccccgcactgcctgtagacaagccctattcccagcaggaaaaagagcatgcccgtaatgttggtcaccagataaaccaggccgtcataaatcgaacggctctcccttttgaacatgatcaggacaccgcagcagatggcggatacctcgatggcaacataaatgttaaaaagatcccgggaaagaaagatgagcatgattaacccttccagtacggtaaacagaaaggaatacagcttattcacccgtacaggaagattggtatacaaaaagacgcataaaaacagaaaacccacgagcatgagaaaaacggaggccgtcagatcacaatacagggaaatccccagaaaatctggactgcctcctgtggtgacgatttccccgccgaagcgtacgcggtaaaacagatggacggtaactccgaataccgcaagataaagaaaggatccgagccaggtagtaaccttgcccgggagcagatacagcagcagggaagtaaaaataggaagtatgatcagaaaatacagttccatatgctatagttccctttccttcctgcgtatttcatgagcggttttccagttggtggtgccgtagcggtgatacagggcaatgaacatcatcaggcccactgcggtaacggcggccccgattacaatagccgtgatcatcagcgcctggggaacaggatcggccgccggcgccgccgactcaccgataggcggacgcatacctgcctcaaaacggataccgaggaaaaagaggataacggaaatatccataattcccagggaaagaatggttttaatgatattcctccgggcgatcaggccgtagaacccgataagaaaaagaagaagccctgtaatttccacataattccatgtcattgcatgtcacctcccgataaaaaggaaagatagatgagccacagccctgaacagaccttcagccctatcaaaacattcatcagcgtcagataaaagcggtgcccgccggtatcccatcccccggaaaacagaaagaaggccatggatgcggctagcagaagcacataaagcagtttttccattttttccgccttttccctggagagcagcaaacgcccggcggcaaaatgagcgttaatcagcagtgcggcaagcactgcgcctccctggaagccccctcccggaccgtccattccggtcacaatgatatagacgcccaacaggcccatgaggaaataaacaggtccgaggcttccggccatgatggcggaagcctttcgcccatccccgtccggcatatggttggcgcttgtaaactgcctttccgttaatgcaaggctggaaaactgcgtcaccccgatgaccgagacaagaagcagcagcgcttccagcagcgtatcgaaaagacggtagtttaaataaatggaagtgaccaggttttttgccccggtttctatctgcccccgctccatgacagcttccgcaacgcgtgcggggccgggagaacccagcaggctgtagcccgtgaataaaaaggctcccataaacacgataaaaataaaagcatgaatccgatgcttcatatagatttccccttataagcggcgatacgcgtaggagccgtatccacaatacgcacctccccgtcaagcccggcctttatgagctgttcccgtatacgtcccaggtactggctgtccgcctctccatacagataaatgccgtcctccctcttctctgcgacaagatccgtatccggccgttccagaagcgtccgggcatttccgcgggattcgatgagatgcgcttccagatcatgatccttcagggagcgtgatatcacttccaggaccttgctgaaaagaggatccttccgggtatctcccggcagacagcggatggtgaatatccggtattttttcagcgtggccagatagataacggtggtgagggcgcttcctataatcgcttccgcaagagccacgtcaggggctcccagcagcagataaccgaaggcgatacaggccgaaagcgcggcggaataaacgacggcggtaaaaagccggtcagtgacaaccaccaggatcccgagtcccagaagaaggagaaggaccgccccgaggagcgtttcattcatcatgctccatacctccttcccggtgccctgacagataggcggccctgcccagtttgtgggcggacagcggcgcagtcaggataacgattcccatgagcagaataaccttaaaggaaaaggaacccaggccctggcggacagccacacccgccagaagaaccagaagccccacggtatcaatgagagaagacagaagcagacgtctgtagaagcccggatttttcagaagccccgctataccgcagagcatgataaaaagtccggcgcccatgaggatttccccgatcactttcataaattcccctttctgcgcagataaacggaaaaaaactgcacatccataaagcccagcagggcaaaaacgagcgccacatcaagatacatctcttcccctgcatagacggcatataacacaatttcggcggcaatgagcgtggatatcaggctgacataaagaatgcgttcaaagcccgtgcggctgcgcagcagcaggataaaagccagtataagcgccgacagaaggaacactatggaaaaaaagatcatgtttttcctccttttccggagagccgctcctcaaaacagcgggaatgatccccgccgtcatcattcatacacagaatggtatattccgaagcggattcctccagggttatggtgccgggagtgagcgtgatacagtcggaaactatgatccgctccctgtcaccgacacatgcgggttccttacggaccgaagcctgcaggggacgcgaggaaagaatccagcgaagcatagtaagggaagaaagaaaaatccgggatgccgtataggcacaataaggaaagaaaggtatccgtgcagcatcggtatcctgacgataaaacggaaaaagaaaaaggcagagtacaaaccccagagcagcgccgaagaggaatcctgtaagggacaaacgccccagcaggacagagaacagcataccgcccatgagcatatggactgacagacgcagagcatatttcatatagaattctcctgtattatttcaagccgcgcccggtattgcccggccgctgtccttatattactaaaaacagtataacaaaatatgctgtttcaggcaataagctaaatctacactgttatagacaataagttaaatttacctcttgacataatttgtaatttgctataagttagatattaacagaaaaagcaaacctgtgagaaagagtagtaagcatcaggaaatatttcagagagccgcagctggtggaaatgcggtataggaactcatgctgaatggacttttgaggccggcctgaatgaagtaggcgtcggcgggaatccgggcccgttatcaatccggcgtgcataattgtgcatgcatatggtatggaatttattttcagccgtatggaaagagtggacgaaatgtcaatttgagtggtaccgcgataataacaggattattaccgcctcaagcattcccaatgggataacttgaggcggtttttgttatgctgttatcatacaattctaaaaaaggagaagaaagttatggcgaacaaagaaattccctacaaaatctatctggaagaatcggagatgcccaagcagtggtataacgtgagggccgatatgaaaaacaaaccggctccgcttctgaatcccggcactctgcagcccatgacctttgaagaactgcggcatgttttctgtgatgaactggtaaagcaggaattgaatgatacggatgcatacatcgatataccggatgaaatcagaaaattttataaaatgtaccgtccttctcccctcgtgagagcctactgcctggaggaaaagctgcagacaccggcgaagatctattataaatttgaaggcaacaacaccagcggcagccacaagctcaattccgccatcgcccaggcctactatgcaaaacagcagggacttaagggcgttaccacggaaaccggcgcaggacagtggggaaccgctttatccatggcctgttcctatttcgatttggactgccaggtgtacatggtaaaggtatcctatgaacagaagcccttccgccgtgaggtaatgcgtacctacggggcaaaggttaccccttctccctctgaattcacagaagtaggcaaaaagatcctgaaggagcatcccggaacgtcagggagccttggctgtgctatctccgaagcggtagaagctgccacaaaccaggaaggctaccgctatgtattaggaagcgttctttcccaggtactgcttcatcagaccgtaatcggactggaaacaaaggccgcccttgataaatacgatatcgtaccggatgtcatcatcggctgcgcaggcggcggatccaacctgggagggctgatttccccgtttatgggcgaagtcctcagaggagaaaagaattaccagttcattgccgtggaacccgcatcctgccccagccttaccagaggaaaatttgtttacgatttctgcgataccgggaaagtatgcccgctgtccaaaatgtacacactgggaagcggcttcatcccttccgcaaaccatgcaggcggcctccgctaccacggcatgagctccattctttcccagctttacgatgatggcttcatcgaagcccgcagcgtggaacagactgccgtattccaggcagcagagcagttcgcaagagtggaaggcatccttcccgcaccggaaagcagccatgccatccgcgtagccatcgacgaagctatgaaatgcaaggaaacaggagaagaaaagaccattgtattcggtctgaccggaaccggctatttcgatatggttgcctatgaaaagttccacaacggagaaatgagcgactacattccctccgatgccgacttacaggcagggtttgacggaatccccaaattccccgggaatgaaatttaagtttaaggtgaaaaatgataccggcgcagcacaggctgcgccggttttgaagtctaagaggaaaataattatgattgattcgcagctaatcatgttagagggtatgccttctacgggcaaaacgacgaattcccggtttatacagatacagctagaacgcaacagcatgaaaacggagtggatacatgaagtggctatgccgcatcccgtgttgttttttgatgaggctgggatgacatatgatgaatatgataaatttataaaaacgtatccgcaaacagcggatattctcaatggcatagctgtattcagaaagagtaccgttggtattcatctgcctgaacttcaatggaactgcggcgataaaatcgacagtaaggtttatcaggcattattggaatatgacgtatggaattttcccattgatgtatacaaaaaatttgccttggaaaagtgggagtattttacccggaaagcgttggaaaatcgggataaagtctatatcatagacagcgcagtcttccagttccagatttttacttttttgtttaagaacagaccttaccaggagctgcaaagctttattgagcagattggagatataatccggccgctaaacccgtgtctgctctatttttacagggaaaataccgaagcgacaattgattatcttgtgaaagatcgaggtatatcatacctggaatatatatggaacagggacaaagaccagccatattatgcggataagccgcccggagcggaaagctttaaacagttccttcgggattacgccgatatggcgaatttgttatttgcttcccttaagataaacaaaatatcatttgaaatttcgaatggaaactgggagagccttgaagatgagatgctctcatttttagatatccatcgtcttccgggcccgaaagcttttccgcaaaatggtgtttataaaaatgaagaagcaggttttgtaatcaatgttgatggcctttccatgacagatccgaccgggaaaataagagcgctttttcccaaaacagccaatgaattttatgtggattggctgccaacaatcctgcgatttgaagagaatagaatcattatttccggttcgcagatctgcgagcgctggactgccatgggaatgatatataaaaaaatgaattaaatgagctgccattgatgaggaatatgcggcaaaacttgtctgcctgacagggagcatatcagttttagtgagttgttcctttaattgattacaggaaatttgattgtcatcacaaatccctttccccaccgggaatccgcttccagcagcagctttagatcatcggcaatttcttttgccaggtacagccccatgccggtggcttttttcctgcctgccccggaatccccggtaaagcccttttcaaaaatatatggcagatcactgctgcgtacaccgataccgttatcgcggatggttaacgagtcgtaaactccttcatgtttaaaggaaagagataattccggccggatatcgtcccggcagtattttacgcagttgctgataacctggctgagcaggaaatgtaagcccctccgatcagaaaaaacgacggaatcacagatgtccatgtttatcagaaaccctttttcttccagcagaggacggtaatcctccagcacatcctccatacattcggacagcaggacggcttccagcagataatccttcctggcacttttcaggcgtgcatagaaaagcatctggttaacggattcctgtatccggtttcggatatagtcaagcttcctccgttcgtgttcgggtatgtcatcccgccggttatcaagcagcatagtgagcagggaaacgggggtcttgatttcgtgggcccaggcttccacatagtcttcatagtcgtatatccggcctttcagaagctggtattcctgctgattttggcgcagcgcggcgccaagaagacggatcatatcactttctgccgctccggagagccggagcagcagctgttcctgatagtcctccggcgaattcagaaaagccagaaacgccttctgccgccggttatcccggaggcataccgctgtaagaacagcagaaaacagtattatcgtgccaagaacaatggcagaggacagtgccagaagggcctgtatgtcggcaagccaaagcagcaggataaaggcgcagtccatgccgagaagcagcagaagccagggcatatgctgcctgcatattttccagatattattcatccttatttccctcaggaatcagctgatagcccacaccgcggacgggtatgattttcagacacatttccagttcctgcatggtctttttcaatctggtcagattgacctgcagcgcattttcgtcgatatactccgtggttccccacagggcggtaagcagctcctctttttttacgggattgccgccatgtgtgagaaagacttccaggagtcttccctggtttccgggcagtaccacggatctgttatggatgtacagggcataggtctggcgatccagcagaaaacccgggccttccagcatatgggagcgtccttcatagcgtttcagcacattagccgttctcgccagcagacgctccttccggcagggctttgtcagatattcatcagcacccagttccagggcatgaagctcatcacgcatctgatcgcgggaagtcagcaccagtaccgggatcgcacttttctgctttatttcccggcagatctgaaagccgcttgcctgaggaagattgatgtccaaaaggatcaaatcaggagataaccggagcagttggccggcagtatcctcaaaggagatgatttcatccacctcaaaaccggcgttccgcagcatttctgcgatttcttctctcatataggcttcatcctctacgacagctatccgtttcaagcgtccacccccttcttttcttattcttcccgttccggtaccatgagagtcagcagataccggaagctcatccttttaacagcagtcatataaatgtattctactatagcaagcagcaaaatcatagccagagatatccacatcagtgtaaaaatatgcggctggctccgggatggaagcagacctgcaaacagcgactttacgccgaaaagactgcttaccgctgccatcgcaatgggaatcccgaaaaaccatcggatttgtttcccggcagaatggcagagcgcctcatagggggcgcctaaccgaatcagtgttttatagcgcctccggtttttctgctgctgtgtgaggaactgtacgcccaataccgtgtttgcaacaatcatgaaaataatcgccagatagatggtaatatagctggcagacaccacataaaacagctgccttcctatgttctgcaggtaactttcatgagggatgcctgcccgggtaagcctgtcgttggtttcggagactgcctccagcagactctggcccttcagactttcctgggaaagcacagcatccagataaaccgtgtaatcgccatccgtcatgcgctcaaacacttcatctggtacgattagcgcaaaggagagggtgatggaacgatcgacaaccaggttgacagtatgaatgcttccggtcagatgaaaggctttgtctgcaatccgtacctccggacggccggaaaggatttcgttcagaatagcgagcttattgaaatcagtgaaccccgtatccatataaaccgccgcttcatcgttcgaaagcgttatctcaggaagcccggagacagcaagcagccggttgtatcctgacagagcaatcagatacggcgcatggtcataggaaagattgttcaggagaatcgctttatcctgagagtcaggcaggctttccagttctttcaggacagagctcatggaaaaagcggcggcataatcctccgcaggattgatatgcccgactttcatttcaaaaagactgtcaaattcatctgaaaatccggcggcggacagcttctcacgtatgccggaaggatcctccgcacaaggaaacgtgtaatcgaggacatgctgttcagaatccttgtaaaactgcgcgattgccacgcctgcgccgaagcagcatagagcagccagaatcagcagcgaactgatggcaagggaatgggaacgatgaattacgttttcctgcagctgacggaaggtgaaggcatgaagcttttccctgcggccggtacgatctgcaagcaatcccagagaagagcggaggccgaaaaaaaacagcatggttccggtaaagcctgacagcagggtgagtcccatatgggaaaccctgttccaggaaaaaccacagatagccatggcatatgccgccgcgagcaatatggttcctgtaaggagagccagtgcatagacggcggagggaagctcctttttcgtcccatccgggggttccgtaagcaggtctccaatctcctcccctgcaatgcgtctgctgagtatcataaaggctgccagtttgatcagggcaaaaccgatggcggtccataggatcgctgtcagggatatattcagacggtgcccgataattcccagacctgcaaggcgtgccgtgactaagctgattagttcagacagcaggaccgcggagggcaggccgatggcaagcacaaacacgctgcttcgcacatcctctgccagcagcagtaaaaacagcctggaacggcgcattcccagcataagatacataccgaattcatgcctgcgccgctccagctgatatttgcttgcaaaataaaccaggaagaacaggatgatcaaagtcattccgtaaaatataggaatcatcccaaccagttttttgacggcatcgctttccattttcatcagaaactttattacgtcctgttgagacagggataaaatgatataaaaggcgataacggagatgagcagggatgcaaaaaaaagaccgttttcttttctgctccgcctgctgtttcgggaaaccaaatcaaagaacatttgcactgccacctcctaactgtgccataaccttcagaatacgttcatagaactctgaccgggattcctcaggcaggctcctgcgcagttcatggaaaatgacgccgtcctggataaacaggatccgtttgcagtaactcgcggcattggtatcatgagtgaccatgagaacggtggcattctggtcccggttcaatccggacagcttctccataagcgcctttgcattgccggaatccagagcgcctgtaggctcatccgccagaataatatccggcctgagtatcagtgccctcgctgcggcaatacgctgctgctggccgccggacatctgtgccggaaatttatccagcacatctgtaatttccagatagtccgccagtgactgcagacgttccccgctttctttccccggaatattgtgcagagaaagcggcaataaaatgttttcccgcccggtaagattgtccagcaattcaaaattctgaaacaggtatccgatttttttaccgcgatactctgcaaggcgtgccccgctcagagaatgtatgtcggtcccctgcatgctgattctgcctccgctgggccggatgactgttgctatacaattgagcagtgtagattttccggagccgctgcttcccataattcctaaaaattcaccggtcatcacctgaaaggtaatgccgttcagagccttcgtcagattgtctgctttcccataaaccttgcacagggattcaatttcaagaagctgttgtttcatatcgatgatctcctttcctgtctttcaacatcatagcatgaggtaacggggaaggatacttacaatgaatgaaagatttccttatggagttactgcttgcagccggaagcttattttttgcagtacagttatcctgctcagttttcaggataaacagagaaaacagctcttatttgatgtgaaatttaatattaatataacgtgaatcatgatacaatcagaataacgaaaataattccaaatgaatacaaagagcttaatgaaccggaacataatttgagtaactatgttagtaccatttgaagtggagtgattttgatttttacggaggaagaagaaatgacatacacaagtttggaacagcgaactgcgcaggggtatctggatgtatttcctttgtttattcccgaggaatctgcatctgtcagcatcaaagagcaaaaggaattttacgatattatgaaaaagctgtataagctggcttatgatgagccgcagctttttgtgccgaaactccacgaggatgccgtccctccgatgctgttcagcggaagatcggattcggaacaggaaacgctgactaacatgaaaaaattccgtaaatccgtagataccctgatctggcagatgtacctgatgggtatcggaagtgaatatacactgaacacccggcaaaagaaaattctcgcaggattgggaatagcagatttcacgaagctttcgcccgcatgggaatggatggcgaaaaaagaacatttggaacgctttgaacagccgtcacgctttgctcactgctgtttccgtgaggaatatctttatgccgccgatatttttgaaaaggctttcgataatactgctttcggcaagctgaaaggctggatgacagcacacggctataagccctttcaaatctgcaacaccactgccagcgattgcaagctctctctgacctatgctaacccttcctggagtgaaggaacaccccggggtggctttgaatacaaaatcaaacacacgggcatatcgatgcggtatgaaccctgctgtaaagaaccgtggattttaggcgtgtgtataccgggcggcatgaagctgtttctggaacattttgatgaaatgccggaacatgtgcaggactttgtaatgtcacggatcaagcgctgcgacggctgccgctactgcgtacagaccgacaaaaccgggaagcgtccatttgccagaatcgcggtgcagtatgcggataaaaaatataatttatgcccttattatcctgggtatagtttttggtggacaagtatcgacgataccctggcaggtaatataattggattattaggttttatggataaatttataggcaataaaaaataatgtttgaattttgtcatcgaaaagtcataaactgtgagaaaccttgcaaatgctgcttttcagaagattaaagcacacaaaataacaatgctttttggagctttggtgcccaaatggtgtccgaatttctcgtggcgatataaaacgatacgggcaaatataaggaaatatcatactaataagttggaattagtggaggtaaataatatgcaatatgcaatagaattgtattacgataaagaaacggaacaaaaactttttaatttagcaaaacgagtagctgatgaaaaattgagtacgaagtttttggaatggaaaaccagaccacatcttacattggcttgttttaatgatgttaatgaaacgaaatgtatacagcaattaaataattttgcaaaaacacataagacaatgcctgcatatattggctctattggaatgtttaatgatacaaggacgatttttgcgtcgcctgtaatgaatgatagtatgtatcaatttcaaagagaattacatgaatatttacaagattttgatataactggctgggaatggtactgccccgatagatgggtgccgcattgtacattagcgcttacaaaagaagatgatgaagaggttttttataaagctagtgatttaattttgcacgagtttagaaaaatgagtggaaagtttgtttctgtagggttagtaaaaatatcatttcctgtggaggaaatttatactattgaattagatgattaaaatcttaatttgctaaagggtttgggatattcccggcaagagaaaatgcggtgcattttacggaaagggtaccctttttctatgcttgccacggaacttttaacaaaggaatggaagggaaacataatggcataagcaaggcagttccaaacggccctatattgtttacttgtggtactaaaatgctgccaaactttacaaaaccaacttatgcggagatataaagcgataaatagaaatatgcgaaagagcctttgtttaagcaaatttcctgtctgtaatgtcaaccttattagtggaagtcaagaaaagggaatgtttatgagtaatacagttgatgataaaagtgttatccgcaatataattttggaaagtcaacatttaagaaataaaagttctgaaagtattgagaatattgtgtcagatatctgtgggttacaatatgacccgaaccctactatacacttaaatcagtatatgatgctctggaacagaaaaaaagactttactgtagagcaattggacatcgcggcgtataaggaatttaaggtgatagaaacattcgcattcaagcggaatatgttttttgtaccatatgatgaatatgcattataccgtaccgccaccaaagggattgtaagatggggagattccgatgaaagttggcttagggttacaaataatcctcaaattcaatctgcagaagtcaaattaaaggagagcttaacaggattgcagggaatgacagcgaagcaaatttgggagcatttgaatttatcgtatgaatggcataaatacagaagagaacacgactctaatttcgaattgcccatatttcgcgctttttatagaatggtacgcaagggggagcttgtgacctgcgggcggaatccaggaactttcagagagccggtatatattttaaaagagaatctgggcattacggactggcctgataaaccaattgatgaaaaacaggccataatctgtatggttgaaaaattaatagcttccttaggagtaaccgatccggttcacatttcacacatatccggtattgcgaccattgatattttacctgtttttcaggaattggtattggagaagaagatattacagcttccatataaaattgggcgcaaaaattattatatccattcttccaaaacgcactttcttgattctaagcaaacggaggacagcaatgaagttcggcttatatcaccaatggacacaattgtgagggataaaaattggctggaaacattttttgattattccttttcctttgagtattttaagaaaaaaggaatgaaatggcctctttcaatccttgtaggaaaccaatttataggttatatagattgtaaaatggaatggaagacaaaaaaacttattattaaagagaaaaatatattcaattctgattttaataattataaaggtattgattctgcaattcaggaattagcgtctttccatgaagctaaagaaatcatagaaaaggggtagtcatataatcatttgtgaagataccaataagcatttataagagcttattatataaaactgaagatggactatattacattgcttgtgcagaaagcccccatccttccatatcctgccggatatggaaggtaaaagaagggcggcttctacaccaacagggaaataacctgctcatatttatctttatatatttctttccccctttcggacagcttcggacagcttcggttcagcttgttttttacaaagtcaattccatcgtcaattcccagcttacgttgtacataggcaagataaaagagggaagggacggcatcgaaatgggatatggaatccgcatcggccacacaaatttcttccggggattgtttttccattaccttgctgcccctgtgatttagaatacatttctgcaccaattccagctttgtcttgtcgtagccgaattccctcagaaaatctcctgccatttccgctccatagatgtgatggttctcatacgtcctaatcctcctctgccttttccatattccgttcttctgtctccttacaaataggaacctcataagtaacataagacccatcaaaatgatacccaagagtttccgccaaatgcagggattccggattcgcggcatcccagctgggataaataccccgatccagacactccagaataagccgggccgcacaagccctggctacccccttcctcctgtgagcctccttcacatcaatttcgatttcaatcccctccctatatacagtataagaagaagcccctcccgcgatttcctctccccaaagagccacaaaccccacacccatctgcataaaatgcccttcatcccggaattgcgaacacaaatcatgcgaccactcttcagacaaaatacgccgatacagccccccatctatcggccgtataacatacccctccggcagcctccccacataactctctaatacatccctctcaaaaacccccttctccttcttaagcgcataccgcctgaacttaacacacctatccccataacaagcttcaatcaattccccccaaccctcatcccgggaagccataagaatactccgggacggaaaagaagcaggaatattccccaccaattccccatccggctcccccgccagaaaacaaaaatcccccgtcacaatctgagcactacgcgcatcaggcaaagaatccgcccaagcctcccccattaccccctgcagacaagaccaaatcatcgtctcctcccagttctcaaacaaatgcccgatatgttccatctcttccgatttaacttgtaccatcacatatttcctttcttaaactatgccctttatagaatttctcactaacatacccccaggtacagataaaaaaagttcccactcccgtctgtgtccctccttttcctgccgttcccactccggcctgccgcgcctttggcggcctggggcatccagggattcctgtaaggggcgtataaatacgccggtccttacgctgcgtcctctgcagcgttagtaccgctgcgtatttatccgagcgaaagcgtcccctgcaaggaaccctggatgccccaggccgccaaaggcgcggcaggccggagagggtacggcaggaaaaggagggacgcagacaaagagtgggaactttttttatctgtaccgccgtcttgcaagcattttagcatagtgttaaactgaataccagaggaagactttaaatgatggcagctttgtcaacaggttcccggcggaaaaggcccgggcgtcagagtaagagaacagagagcagaagtatatagaaggaggcagaaggaattgaacagaaaaaaagcaggaatgatagcagcggcagttatgcttcccgttaccgcaatagccggcagcgtggcgtttttcttcacctatgcggtcgtaaggatggagaaaaagaagaaaaagaaaaaacggaagaaagcaccggcagctccgaaggaaggtgaaggccttacttttggctgtttccgggataagatggaggaaggaacgcgctggttcaaggaacaggatccggagaagataacgcttaccagctatgatggcctgaagctgtctgcttacctgcttccggcggaaaagaaaagcaggaacgtccttttgctcatgcacggctaccgctgtgacggcttttcggatttctcctgcctgtatcagttttatcatgatcagggatatcatctgctggtgccccaccagagaagccatgcggaaagcgatggaaaatatatctgttttggtgtaaaagaacgatatgactgcaaaatgtgggccgattatgcggtgcgccgatttggaagtgactgcaacctgtacctgtccgggatttccatgggcagttccacagtgctcatggcggccggactcgacctcccttccaatgtgagaggaattatcgccgactgcggctttacaagtccttacgatattttcagacatgtccttaacctccagttcaggctcccgtccttccctctgatgaacctgacggaactggcagtgaagcggaaggccggttttgattataaggctgtttccaccctggatgtgctgaaaacctgtaaaattcctgtgctgttcatccatggaggcaaggatgattttgttcctacgcagatgacgctggataattattctgcctgtgcctcacccaaggagctgctgatagtgcctgaagcggggcatggcacctcaaatatggcggaaccggaacgttaccgggaaacagcgcttgcctttatgaaaaagtatgaaaaatagagtggtgtaaatggaatcaagaacaataattttccatattgatgtaaacagcgcttttttaagctggagtgcggcttaccgtacggatgtcctcggggaaaaaccggatttgcgtacggtgccctccattgtgggaggggatcaggaggcgcgccacgggatcgtgcttgccaagagcacgcctgccagaaaatatggcatccagaccggggaaccgattgtggccgcgagaaagaaatgtccgaacctgattataataccgccggattttcacatttatgtggagaaatccaaagccctgatcgcgctgctgaagcagtattccgacaaggtggtccaatacagcattgacgaagcctgggcggacttcaccgggtatgagatgctgtatggcgagcctgtggcgttcgcccatgagctgaaggataagattaaagaggaacttaagtttacggtgaatatcggtgtctcttccaaccgtctgctggctaagatggcaggggatttcgaaaaaccggatttggtgcatactctttttcctgaggagatagaagaaaaaatgtggccgcttcctgtggagcggctgtttttggtgggaaaagcggcggcggataagctacacagcttagggatatatacgataggagatttggcccgtacggatcccggggcgattaaggctcatatgaaaaagcatggggaagttatctggaattatgcatggggttgtgaggaagaggaaacaatagaggccaaagaaggcaataaggcctatggaaacagcatgactacgccggtaaatgtcacggatgtggaatatgcaagacagatccttttgtctttgagtgagaccgtgggaatgcgtctccgggcggatcaggccaaaatcagctgtgtgagcatcacgctcagaagctcggactttgaaaacaggaacagacagatgcagttaagcagcgccacggatgttacggaggaaatctatgtatcggcctgcaggctttttgacgaattgtgggacggaaagccgctccgtctgatcggtgtttccacttcgagagtcacctatgaggaataccggcagtataatctgtttgaccaggaaaaatatgataagctggaaaaatgcgataaagcgatagacagcatccgtgccagattcggcgaggattctataatgagggccagttttttaaacagccgtatttcccatacgggaggaggcctgaataaggaaaaaagagcggaggcggtttccgatcccgggagggagaggaaaggaaaaggagagaaaaattgagaaatagaaaggggatagggcttgtcgtcctgacggccatattgcttttgtcaggctgccaaaacctgccggggccggaagaaacggttcccgcaaagggacaggaatcacaggaagaaaggccgttggagacggattcgcccatagaaacacaggagaagcctgttatggaaagtatgccggcagagccggctgccggacaggagcctgaagccggagaggatgcctccgggcagcaggcctttaaagaagaaaaccaggaaaagggacttccggaaaaagaggaaaaaccggcagaggaggcgtctgcggaaccgccggaagaaagtctgccggaagagattcccccggcagaagagcaggcggggcaacaggcagaaccgccggatgaagcggcggaggggattatggtagagaaaaaaacactggtgattccgggattggagagggaatacaggtaccttttcctttccgatacccatatcatcagcctggacggggaagaaagcgagcagcagctggaaaatgccctgccgcgcagggatactctttttaaggatgagttgggaaggacaccggaggaggttttcccggactggatagcttatgccaatgagcagcaggtggacggcctgcttctgggaggtgatgtaattgatttcccttctcaggggaacctttcttttctggaaaagaatctggaaatgctggaaatgccttatctttatgtcccgggaaatcatgactggacttatccgtgggaatatatgacggataaaggcaggcaggaatacctggcggccctgtccccctggatgaggggaacgcctgccgctcagatgatggaaaacgaagagctggtatttcttggagtggataacagcagcaaccaaatcgatcctgccgccatggataccgtgagaagcgccatggagaggggaaagcccgtaatcatcctgcagcatatcccttttgctacggatcgtctggtggatacggcggccgggctttggaagaatccggttcttctgggaaaaggagtgctgggcggtatttaccccaatgaggcatcccaggaatatatgaatctggtattaggaggcggcagtccggtaaaagcggttctggcgggccacatccatataggagaacaggacagcctgacagaaggcattgtgcagtatacggcggaagcgggatatatggggaaggggcttctcctgattattaagggagaagaaccgacagatacgcagccggattgacagaaggaaagaaatgcggaaaagaatggggataagatatcaggaacgatatcgaatccccattgtcatgcttcaataaatattatccttattacctgattccgaacgaaatgcctcagttctttttcagccggattgtctttacttcaaaggcgcggaaggaaagaagaatgccgccgttttccacaggggcttcctccaggatattttccagcatatcacacacataaggcgtgtaaccttcaaaagcagtatgaatacgggcggttaccgcagcctttttggattcatacagacgcaggatgatatcttcacttccgtcttctgcaggcttcatggtatccagaatgatattttcccggtcaacctctgcaagactgaagcggcggttgcttcccggcataacgagagcgggcacattaaggtcatagccctgccgaaccacatcacagtctgcgaaggtgccttcccatgcagtaaaagcataagtaaaatgatgtactttattatccgcgcgcatttccggtgcggaaggggctctcagcagcgtcagttccaggctgtttccattcatgctgataccgtatttgcagtcattgagtacagctgcgccatgagcggcgtcgcaaagggcgctgtaacggtggttgcagacctcaaaacgatccttgtcataggctttggaacgatgtgcaggcctttccacataaccgaactgcatttcattgatgccgttttccgtgtatacatccacagggaaagcggtcttccataaacgatggagttctttccagtctgcttcggtatcaaataccagacgtctgctgtcggcagccagacggatatactgcgtataggaagattcgcttatgcggccggaaacccgaagcacagcctcaaggccctgagaaaccatttccactgtgatatcatgagcgccctccacttcctgttcgatatagttggaatcaatatcccaggcgtcgaacagacggggaacgtctttatacagatggaaacggttcatgggagcagcggcaaattcccttccggattcttttaaacggaaggaggttacttcaccgcgaaggtttacagcggcctttaccacactgttttccagaacgaatccgtcctccgtttttacagcggatgcgcctgccaggggcttttccgcttcctgagaaggaagaagagtaactccgccgcaggaagggagatccacaagcgcttttacaccgtcctgtgcagcctgtgtggctaccggaaggccttctgccgtacatgcgccgtctgcaaaggcttcaggaagggataccagagcctttctttcaaagcttaaggagttgaataccgtaacggcattgtccccctgatcggttagcagggcatttgcggcatccgcggtaatttgcgccgcatcatgaaggagctccccaaaagctttttccgcttctatatatactctggcgatggaggaaccgggcagaatatcatggaactgatgcagcagaagctttttccagagagcgtcagcttccgaaagaggatattcccatccttttgtcctggccagacagctccacatttccatttcccgaagggcaagctcactcttacggttatttttctttaccatagcctgagaggtataggttcccctgtgtgcgctgaaatacagttcacccacataggtgtgtttggggccgccctgttcctgcatttcttcaaagaattcctttggcccttccattttaacctttacgccgccttccaggtctttctggcgcaaagcatattccacataatctctggacggaccgccgccgccgtctccgtagccaaagggcaggagaaaagcgtccagatcctgtacctgtgtcctgtttttccacacttgattgacttcctttggatccgtgcggtatgtatagctggtgggcaggaaggagtcaacatgggagccgtccatcccttcccaggtaaaatagtgataagggaactgatccccttcattataagaccagaaaatcttctgtgttaccaggtatttcacaccgcagccccggagaatctggggaagggcagcagtatatccgaacgtatccggcagccacagtacctggctgtccacgcccaacacttccttataatagcgttttccatgaatcagctggcgtacaagagattcaccgctggtcatgttggtatccggttccacccacatggctccgtcagcaatccactggccgccccggatggcttcccggatccgttcaaaaagctcaggataataggttctgcacatttcataagaagcgggctggctctggatgaatttatattccggatattcctccagcagacgaagctgtgcggcaaaggttctttctgttttgcggtgtgtttccgccataggccacagccaggccaaatccagatgtgcgttgcccactgcatagaaaacaggcatagtggaaccgtttacagcctccatggcaggacgcagggcttccctggcggcacggtagccggcaatccttttttccttatcctgttcaaaatccacgatgagtgtgaattcctccagtgcctttgcgatctttgcggctctcagggaagtgtcatccagggtttccagcagcttattcagggtatctacgtccatatacagctgataggcatcctcattccagattccataggtacagcagcccagagtccttctggcgccttccggcaggggatccgtaaaggaacccggaagaacaggaccggtagcacagcctccgtccgaacattcgggataataatgtccggcataggtttccatcaggacttcatagctgcttccggatttcccttcccttgccagcacattatcctccatataatgatgaggttcgctgacccagtctgcccggaaagttccgaaagcctgtccgtttacgaagagggcggactcgccgccgggcttcagattcatgacaatccgtttcccttccgcttccgggggcagctcaatatggcttctgaaccagcaatactcataggtattgccccatgtaaatccgggctggaccggagtgaaagccattcccgcagcttcctccggactaagatgctccatggttctgcctgcttcccaccggaattctcccagcggttcataaaaatcgtctttcagcgtacggatccagtgcttaatccgcccgctccattctgaatgcatcactttcataagggcactcctttacataaatagttttgtgttttccctgttgtcatattggtaaaaactgtaagggtatgcttttgttatagcaggttatggtggtgttggcaatcaattatttttgcttttttgtcattctttttttacatggatcgggcggcctgaaatcatggattttgataatgggagaacggaaggacgtacagcggttccggaagaaaaatcgtaataaaatagtttttatgtattgacatttattctcagatcatataaaatacattttgtcgcgcaggaatggcggaattggcagacgcgcacggttcaggtccgtgtggtagcaataccatgagagttcaagtctcttttcctgcactgtacataaggctttcggataagaaatatccgaaagccttatttttttcatgcagcggaagctaagaaattaattatacaaaaaagcacttcagaacagttatccattctgaagtgttttatgaagtgcaggaaaagagacttgaactctcatggtattgctaccacacggacctgaaccgtgcgcgtctgccaattccgccattcctgcgcgacaaaatgtattctatatgatttgaaggtaaatgtcaatataaaatgttaaaaaaattattcaaaaaaattacttgcaaaaaaaatcaaaaaatctgaaaaagtatattgacttatttgttcccagatggtaatatacctcttgcagcacggagcacaaagctgtgcaggcatgcggaagtgtcggaactggcagacgagcaagactaaggatcttgtgagcaatgcgctcgtgtgggttcaagtcccatcttccgcatcgatgaatggtagggaagtccttattaaaggatttccttattttttcatatctcacaccttactcattctttttcaggtttaaatctccccaattttttataacatctaagactgacataaaacttttacccagttcggtaagtgtatattcaacccggggcggaacttccttaaaatcatgacggttaataaagccatcggcttctaattcccgaagctgttttgttaatgatgactccgtgatatctccgatatgacgccgaagctcaccgaacctatgtacgttctgtcttcctatataataaagaatttctattttccatttgccgcctaatattttttggacggtcgatattgttacacatctttgtatggcttgttccgttttcttcatggctgtctcactcctttttagtatgatacaaaaaatgcacaataaaagcaaggtacgctattttaatatagtactataaaaaagttcagtacttttaaaattaatgtacaatgatataatctgtgtatgcttttgaaaggagtaaaccatatgcactacacgggaacagtatggcggccgccgtatgaagcttcatccttacttttagaggttacagcagggtgtacgcatcataaatgcaaattctgcacattgtatgatgatatccctttccggttcagaatgtcgccgatagaagatattgacgccgatttaaaagaggcaaaagcacgcttccgattatcaaatggcacccatatatcacggacctttttagtgggtgccaacccatttgtactgaaagcggcacgtctgtcggaaatttcttctcttattcggaggtattttccaacaaataaaagtatcggatgtttttcaagaattacagatatcacattaaaaacggatgaagagctgcttgcactgcgggatgcgggatataacggtcttacgataggcattgagacggggaatgatgaagcactgaaatttatgaacaaaggatatgaggcacaagatattgctgttcaatgcagacggttggataaagcaggaatagcatacaacttcttttatctgaccgggatatccggcaaaggaaacggcgaaaaaggggcaatggacacagctgatatctgtaatcagctgcaccctcagataataggggctaatatgcttaccatctatccgaatgcagaactttatcaggaaatgctggagggtaattggcaggaagaaacagaaattgagaaatacaaggaactgaaaactctggtggacaacctgaaaattcccgtttggtttgcagcgggcggagcttcaaatgcaataccgattcaaggtacgctgccgcgagagaaagggaaagttatatccgtgctggataaaattattcaaagcgtcagggaagaagaattgagatgttaccgagaaaatctcccgcatttataattatgttaaggaagtgattttatgaattttacgggaagaacatggcggccgccctatgaagccggttcctttattatacaggccgcctctggctgtacatataacaaatgccggttttgcagtctttataaaggggaatgctaccgtatgtccccgttaagtgaatgggaagaagatttgcaggaactgagtttatactaccccaacgcccgtaggatattctggacaggtgcgaatccttttgctatgagctatgagcacttaaaaacaagagccttgtccgtatatgattatttaaaagaatgccagactatggcgatgtttgcaagtatcagggatataaaacctaaaaaggtaaagcagctgagaacgttgagaagccttggtattaacggccttagcataggcacggagtcgggggatgattacacgctccgcctggctgataaaggatataccgcaagagatattattgaccaatgccgtaaactggatgaagccggtatagaatactatttcgtttatatgacgggacttgccggaaaaggaaatggatatcagaacgcagtcaatagtgcaaaagttttcagtaaagtcaatccacgttttatttctgtggactcactgaccttatttgaagatacagagctatttgaaatggctgaacgtggggaattcgttcctgccggtgaaaaggaacgtattgaggaattacaggtttttattcagaacctgcggctaaaagtacatttatttgccgacagcatatcaaatttttatccggtgacagcgtatctgcccagggataaagatctggtaattggtgaattgcaaaatattatggatacggtaagcgaagaagaaatgcttgcgtacagacgtaatttaaaggctttaggttaggttattttataaaatttatttaatgacagcttgcatttgaaaataaaaatgctaaaataccacatataagcacaaggtcgtgtaaaaacaggccctgtgcttttttcgatcaatttatttacataaggaggcagaatatgaaggatgtaattaaagtatcgacagtcgcttttaatgcaaaatggggagaaaaagaaagaaacttaaatcgtatgaccggctatatcgaggctgccgtgtctgaaggctccaatattatagtattcccggaaatggggctgacagggtatgatgatgaagaagataaaccaaagccggaaaaaatccagtataagcttgccgaaacggtacccgggaaatcatcggaagtgattgcagaacttacgaaaaaactgggcatatatgccgtgttcggcctgcctgagagggatcccgatgacgaatccaaaatatataacgccgcctgtgtatgcggccccgatggaattgttggttcttaccataaaattcacttgccatatccggaaccgcactgggcatcaagaggaacagccccttttatttttgacacggagtggggccccataggattagggatttgctatgatacctatagctttccggaattgatgagatactatgccgcaaaaggatgccgtttatatattaactgtactgcactggccaaatgtcatggcattgccatgggttcagcgactctggaggccggctgtattatcaatcagatttatatcgtatcctcaaatctcgcaggaaaagacctctgcaatgtattctggggcggatcaagcataatcgggccaagtactaacgtatgggaagccgagtattttgccgggtatccctttactgatcccagggcaatccaaaataaaatgtatactgcagtaatcgatttggctctggcatcccgtgaaatatttgaacctaatgaattaattaacggggccacggatttcaggccggatatatataaagaactgatggaggatttacttaaggatcccaaattccggaaaaaagaatgtggatcaaaataaaccatacaagtaaaatgtgagcctggcaaattccattttccgtcattctgccgtctgataatgtaaactctacggagcgtcggttgcaaataattcaagctccgtatatgattttggttattgcagcaaataggcatttatcagaaaggaagaacaaaatgagtgagttttacccaatagatatgcagatatggccaatggctcaggcattccattattatacccggatggctccgaccagctatacggtaaatgtaaatatggatgtgacaattcttagaaaggaactgaaaaaaagaggatataagttctttccgacttatctttatttagtaaccaggggcatttcaaaccagcaggaactgcggattcatgtgaaagacggagttttgggatattgggataacctgaccccggcctatccgcagtttcatgctgatgacagaacgacatcccttctgtggacggaatacaatgacaaatttgagtgtttttataacgattaccttattgatacaaagcagcatggacagagtcacggtatcctttcctcaaagggtgtgcccccggcgaatgcctatatcatttcctgtatcccgtggtttacatttaacagcttttcccttcacaaccatggaattaagaattattacgtcccgagctttgaggcaggaggctttgcagaaaccgccggcggaaagatcattatgccgctgtctgttacggttcatcatgcgactacagatggttatcacttaaaggtgttttttgaggagctgcaaaggatgatggattgtcccggagagtggctgtagaagtgtttggatacgagaaaattggtttgaaatatttagaggggaagatttgtatgaaatgttttatctgtatgacagtataaataaatatacatcgctatatttatggtatgagatagtgtataataaggcaaagtgaaatttaacagggagaattatatgtttagatatgcacatacgaatatcattgctaaggacagtcaaaggctgataaaattttataaagaggtattccggtgtgaaagtatcggagaaacaagggacttgcgcggagaatggcttgacaggctgaccgggatctcaaatgcacatatagttggagaacatctttgtttgccggggtatgagaaggaccaccctacacttgagatattttcctatgatacaatggataatacttccagagtcctgaataaatgcggaatagcacatcttgcatttgaagtggatgatgttgaaatgacactgcagcttttgcttcaaaacggcggcagtcaaattggagaactggtaaagacagaatacgaagatggaaagaaagcagtttttgtatatgcagcggactgcgaaggaaatatcgttgagatacaaagctggtcataggctataaaatgtcgaatttacccggatatgaagttcaataccggtcggagactgcataataattgatgagagaatgatatgaaagtgaacaataatattttaccccaaaagaatacaattcaggatgctgcagttcatttatataaggatcataataatgtatattatatgtgtaaaatcagcctcggacattcttttatcaattgcattgtcctggaagaggataaagtaattgaaatcgtagatattcaatgcgagacaataaatgatggcatcggttcattgatgatggaaaaattgataagctatgcgtcggaaaataattactgcaaaattgtgggatggttatccatagttgatgaagagcatatagacaggctcaggcatttttacataaagcatggttttacaatcaaaacagaatacgacggtatgaagctggcagatattgaactgtttattacataaaggcagagagaatgatttgacgggagcagagagctgttgcaaaagcaggcagaaaacctgtatggcaacagctcatttggttttctgaaaagataaacagggtttacaatatttggtaatatttaccgtgagccggcatataataaaataatatggggttttccggcctgaagcagccggagagccagaaaccgttttggcctgcggcaggcatacggtaataatttctgtttgacacagagggaggaatcaagtacaattttacagatcaggtgtttgttaatctgaatatgttttctgcctttcatataaaaaggcggagggaaacagcggcataggatacagagatgttcatcttatgtgtatgcatgcaagagtatgcatgcaattatgcagggaggtagtaagtatgaaaaagaatataggtatccttgcagggcttttcttcctggcggccgttttggcggcctgcggaaggagtgcggaggagactgggaattttaatacgccgggcaacggttcttccggcagtttggaaacaattctggcattggaatcggaaacagctggagccacggagacgggagagccggaaaccgttcttatttattacggatccagcataggaaaagaactgaaaacagaagaggtggatttgccaaggaaaacaccggaggctatcataggcgctctgcgcacgaaaaatatcgtgtcggtggataccaaggtaaatgacttcagcatatcggaggatggaaagcatatcacactcgatctttccgcagggttccgggattatctgaaaaccatgcaggaggggagcgaagcggtgattatggccgcgctgaccaactcttttctggatgcctatgatgcccgggatttactggtgacaataaacggcgagtgtctggaaacgaaaaacaggacttataaggacaagcttgtttttgtagattttgtggaataaaggggctgcatttctggaggtcagaaatgcagccttcttcttacggcgccccgcagacgttttctggacagcatggtaatcagggctacgatgataacggcacaggcagtcagaactaccgcagaccaggtaagcatataaggctccgcaaagaaacggcggataagcagctcgatggaaacacagaggacagccacctcggcaaataagtaaagggcggtagcgaggaaggatgacgctattctccggttcagcgccgctatgatgatcgcaagcagggtcacgattccggtaatggggagcgccagctcataaaaccagcgggaactgggagtgttaaaggtaatcagatattcatacaggacgatggcaagcccgtcaaacagcagggaaaaatagacgggcagcttcgtataaataaaagcggggatggcaaccacccacaggatgatacagatgccgatcacatacagggaccaggcgctgctgttgaaggccagaaggtttaagaggccgcaggaggcgccggtggcgatgagcaccagggaataaaggattgccatgtctttgttctttacggtttccacctgtccgttttctttggggaagggagggacggaatggctgcaggatacctcattgggattgatgaccggcgtattacataatgggcagcgttccagggaatcatccagctttacgccgcagtttacacaatatgacataattgactccaatctgctgtgaaagaaagagattcacagcgttttttatttttcacgaaacaggaagcgttaaatttcttcatcaaaggtacggttgctttcgatttttacatgaatgccgtcttccacgagcttgcggaaaaaataacgttccacatccgcttctatgatacagctggcaaaatttatggtcagtgtatcttcaaagctgattatggcgcaattggtacgggaggaaaagggctggcccatataaatatcgaaacggtcaatatagggcttcatgtcctccggaaccttcatggcgcccatatttgtaagccctgccgtggaatttttatcctgaaccttgcggtaaaaggttctcaccacaatatccttcagaaacagcgggactatccggataaaaggattccgggtggtggatgcattggtagtgatatcgcctcttaagaatttttcattgatataataacgcatgaaattatgaacctgggaaacaatttcttcaaaggtatagttccccagcctgggatcgatggaaggataaaccatggaaatgaagttcctcagggttttggaagggaaaaaacgcctcaggtttaccggcagggcgatcctgaccggatacagcttcagatggaaatccatctgctgtttgttcagcagggcataaagaaggaccgaattcagatattccgtaatggtcgcgttatatttggcggctacggccgcaacttcttttacggacattatgccgtctataatattgaaggtatggaacggctctttggtaccccggatacggtaagtcttttccgcagggcggggagggcagacgagggcattggcatagcgcatgtaggcgtcttccaattcttccggatccggttcttcgtccacattcagcacaaaatagccgttggatatgtgggcgcccagaaggcggagatatacggcggtgattgtctgaagcacgcacatgccgccggagccgtctccaaggcaatgatggcattccagggaaatgcgcctgccataatagaatacccgaagcagataccggcttccggatttaaaatgcatgggcatacagggattatggatatccggcttcacaaaagggccgggccggttattcggctccagataacgccagaaaagccccttatggatgcagaccttataggtggggaaacgcttcagggcgatatccaccgctttctgaagtacatcaggctttatgtcctccttcagaaggacggaaagcctgtaaacggaagaaaagtcccgtctctgcagtgtggggtatacaatagcggaaagatccagccggtaccagtccttcgggggatttccgggcgccttgctgcttttattatttgtacgcatatgaaatgtcatcggctttattcctttctctgatattgatattataaaattattcctaccgttatgcaagttacagttcacagccctttttgccggcgcgtccctctcctcccctgtgctcccggtgtgccgcctcccgcaaggattcctgtaaggggcgttataagcacaccggtccttaggctgcgtcctttgcggccttagcaccgctgtgtgattatccgagcggaagcgtcccctgcaaggaaccttgtggaaggcggcacaccgggagcacaggggaggagagggccgcgccagcaaaaatggctgtgaactgtaacatatgcaagacaatcacaaatactgaacccctttacgtgattttctttctatgataggatgaaaaagtaagaattatgcagatactgccgatattgccaacaggaaaatgaacagtccggagaaaacgcagcaggaatgggcgtaatccgggagaatgagaggaaaaatggcactttttgataaatctatgaatgcactgaaaaaaaataaggagcaggaacagaaccagaatctgatgaaactgataaaaagggttcacagtgttgtggaaaatacggatatagaaaaacaccggcagtctcaggattatttcggggcgctgctcgggagcagcaaggatatggatatctgtcctgtggaagtggaagggatgcactgcgagtgggtgcggaccaaccgggtgcatatgaaaaaatatgtgattctctattgtcacggcggcggttattccacagggagctgtgtttatgcgagaaccctgacgaccaaactggcggcctccacatcaatggatgttttctgctttgattaccgcctggcgccggaatttccctatcctgccgccatggaggatgccatgaaggcctggaattatctcatgctcctgggctatggatccagagatgtgatcgtcatgggggattcagcaggcgggaatatggctctgtccctggtggtgaagctgaaggagcaggagcgccttatgcccaggggaatcgtccttttatctccctggacggatcttacggcttccgggaaaacccatgaaagcagggcggagctggatccggtcctggatgaagaatatctgaagcagatgacggaaaattatgccgcggggcaggattacgaggatcccctcatttcgccgctttttgcggacctgacaggatttccgtccacctatatccaggtgggggataatgaggtacttctcagcgactccaccatgcttcataaaaaaatgataaaagccaatgtgccggtccgtctggatgtattcaagggaatgtggcatgtatttcagatgtcgccttttaaaacggcatatgaggccatggatcaatgcgccgagtttatctttgatatctgccgctgataaaaacggcgggggtcagccccggaagccgtatccatagctgccgggagagtaaaaatataaggaaggacaaaggaaagcagcaatgggaatccttcataaagcagcccagtaccgggcatataaagaaggggtggtgcatgccaccctgaatcccaaaggccccggatcagtcaggatccatctgattcctcccaagtggaggcttttttcaaatgcgccttatgtcatgatattaaatggttattacatattgcccctgggttattcctgggccatactgctgggcagcttcatcggtgaggtaaataaatttgaaggggaacccatcgatgaaaagcatatggaacagatcatggacagggctgctgccaggacaaggcgtgtatactatgtcaaggaagaggagctgcgggcggatctgcaggagattctgaccatgctgtatggggttgccaggggagaggagccttcaggggacatagaacccctttcccttcgtgaatatgcccgtaatatgacggcccctcaccgtatggatctcatgatcagttctatgctggatgaaggcgggaactggaactgcagcctgaaatgccggaattgctatgccgccggtcagcctgcggcgggaggaaaagagctttcgacccaggaatggtatgagattattgacaggtgccgcagggcggggatttgccagcttacctttaccggcggtgaacccaccatgcgcagcgatttggcggagctggtgaggcatgcccgctggtttgttaccagactgaataccaatggcgccatgctgacaggggaactttgtgaagccctttatgaagccagcctggacagcgtccagatcaccctgtattccggagatgccgggatacataaccggctggtgggagcggagctgccgggaagcacgggaaattgggaaaaaacggcggcaggcctggagaacgcgcttaaggccgggctgaatgtgagtgtaaatactccgctctgccgtgaaaatatggattatatcaggactctggcctttttaaacagggcgggcgtccgttatgtcacatgctccggcctgatcgagacaggcaaagcggagtcaggggactcccagcttaccgtggaggaaatgaacagccttctgcgggaggcgattgccttttgttcacagcacggaatggaactgagctttacgtcacccggccgggcggacaaaaaggtgctggaggagctgggaattgccgttcccatgtgcggcgcctgtctttccaatatggcggtcgcaccggacggaagtgtggtaccctgtcaaagctggctgggggaaggcgcggccctgggcaatatgaggaaggacagctggaaaaaaatatggaaccatccttcctgtaaagctatccgggaaatgagtgaagaagaagccctgtactgtcctttgagaagggagaagacagcagaggggaaggaagcccttatatcagggaaaccaatgcggacagaaaagaagaaaacgattatatccgggaaggcagtctgaaaaaggaagagccggctgcagccggaaggatttttatcattgtgaacagcaaagggaggaaaagaaggatgacattaggggaagtatgtctgctgacaaatcaggtaacgaggctggccgggttctataaatggctgctgcatgtggaaaatgacagtgacgatgaggtccatcagacgattctggctcaggaaaccatgctgactatctataacgacggagaagaccatggcctacacagctccaatataactcttgcgtttacggcagaaaatgtggatcaggaatatgaaaggcttctggaaaaaggggtggaaatctgcgaaaagcctgtcagcaggccctggggagcacggaatatgagcttctatgatccggacggaaacctggtatatatcaggagttttcccaaataaaaagcagagggatgtatggaaaagaaggaactgcggttctgtcgggaaaatgctgtataaggagaatcattatgacggaaagagaaaaaatgcttgccggactgctgtatgactgcggtgatgatgagctgctcgcccgctggcataaggccaaaaatttaatgagagattataatctgactgattcggaggatatggaaaggaagaaccgaattctggaagagctccttggcgggagggtaaagaatctgtggattacggcgcccttttatgttgactacgggcatcatatttttttcgggaataactgcgaagtaaatatgaactgtaccttcctggatgataatatcatccgcatcggagacaatgcgctgattgcgcctaatgtacagatttatacggcattccatccggcaaatgcagaggatcgcttcggaaatcccggaaaagacggttcctttgccttttgcagaacccagacagcgccggtaaccatcggtgataatgtgtggattggcggaggggcgatcctgatgccgggcataaccatcggagataatgtggttataggcgccggcagtgtggtaacacgggatatcccctccgattcggttgcctgcggaaccccctgccgtgttatccgggagaataagtagaattacggcgccggtgcaaaatttataccgattcttccgtatcgtacggaatgattatctttttcgcttcactcagtccgccccggatcatatagctgcggacgatagaaagaatatggcagtaacactgggacaggcagtcggaaaaaccggcactgtcccctttttgcatacagcggaaggcatgcaggcttaattccttcagccgtgtgtggcttctgataccatggctgtagaaggcaaaatagtacccccatagcagaagcttgttgcacccatccaatatggcccttaaaggctgcaggggcagcagatctgagatgcaggcaaaaatagaggcgagcgggatattatcgggcctggaaaattcattctgcagccgttcctgaacagaggcatccatcagggggaaaaccagctgtacggcgggacggatggctatagccataagctggagggcgcttaaatagaggagcgtatctcttttataggtttcatccttcatacagcggaaggtggtttggtcgtcaggaagtatggctatggtccctctgccgttctgggttacggcgaatccgagtacattgagggtggaaagagctttcctgacagtggcggcagaaacatggtactgctggcaaagatttgcttcggaggggagaaaggtaccggcttcataaacgccggtgccgattttgtcaatcaggtcccgggagatctgggtatagtaatgatcacgtccccgttcgggagtccaggagaaagcagcgtccggaagctcccggatattcggaaaacggactgacatttgctgcagacagtcccggatattctccgataccggtgcatagaggtcaaaaaaggcctttcggatttcctcctgctgttttcccggaagaagctctgccacagcggcaagccgccgtttttcttcttcgggaatgacataggagggatcttcctcacacattaacacaaggggaacctgggcgtacacctccaggctggcataaaggtcgttcagcagaaggctccccgtttcacgcagcaaatcatgaaacaggttggaaggaatacgccgggttttatcgccgcttcctttttggatatacttccggaaaggttcgtaatgttccagctgctccggggtgcagttgactgcggcaaaggaaaacaggggaggcatcagaagggcgattgtctgaaaggtttccgcaagtgaggtcctgcgttccagcacatagctcaggatggaattttcatcggaagttctgcggggacggtaaaggacaacagccgtttttcgttcctcggtacgtatcagcccctcttccctgagcgccgccaggacatcctttaccgtgcggatgcccacatggtaaatttcacaaagccggctggcggagggcagcggactgccatattgatagcaccctgtcagtatctgttccttcaggctgttatataaaaaatcatacaatgtttttttgcgctgcatctgtatttctctttcccgattcttatttatattattataaatcgattattacacttataaattaaaatatcatatctcaaatacttccatcaacctatttgtatatgtactcagattttatcttgtggactgaaatgtttcgtactaaaataaaatcgtaaaaaacggactttagtgtgacaattgattaggatgaaggagattttctgttacattatgattcgggaagataagaggataaaagaaaataatatactgcgggcggaaccaggaatcgtgatagctgttctggctgtgctgatattgctcatagcagcggtgaccatccaaagtgcattagggctgaagacggctgtggataggactacgaaggcctatgtaagtgatgtggcggcccaattggcgctggatattgacgatcggctttccttgtatcaggaaaataacattattggcgttttggaaggaacaggaaacaaggaaagcatgcagcgtttgattcagccggtgagctttgacggacagggattaacctgcatcgctgatacggaaggcaatgtggtgatttcccccacggatctggccccctttatgcggctggatgatatatttaaagaggactccgaggaaacaaccgtccgcaatattaaacggatgcaggaaaatatgaaggagggcaagaatggggtattttcctttgtcgcggtggacggcagggagcttatcctctcttataacatactgaaatcctatgactgggttttgcttaccctggtgcccgccgatttgatttcctatgaaactgacaggtatgttatacagacatttgccattgtagcaggaacgattctcctgtttctgttctttttgctgatattgctttttatataccggaacaacagaaggcgtctggagtatatcgcctttgtggatgctgtgacgggaggaatgaacaatgccgccttctgcctgaagctgcgggaaacactgaagaacgcccgcaggaatgagtacacggtagcggtaatcaatatccgtaattttaagatgataaacgaaagcttcggaactcatgagggagacaggacgctgcattattgtatgcagatcctccggaaaaatgtgaaggaaggagaaattgcggccaggggaaatgcggacgattttttcctctgtctgaaagaaggaaacaggaatatcgtggcggcaaggcttcaggaaatcgtcagggagattaactcttttaatgagaacctggagaacccctatcatctgtccttccgccagggagcctatttgatagatgaaccggatctggacagtaccatcatacaggacagggtaatgacggcctgcatgaaccagcaggaattcggggagaacagctgtgtgttttatgatatctgttttactcaaaaaatgaaacaggagcatgaactgaatgccatgttccggggcgctctggaaaacggggattttaaagtatattttcagccgaaggtcagtcttgaggatgaaaaaaccgcgggtgcggaggcgctggtgagatggcagcatcctgaggaaggaatgatatccccgggtgattttattcctttgtttgaaaaaaacgggaatatatgcaggcttgactgctatgtgtttgaggaagtgtgccgaacgatagaccgatggagaagggaaggacgaaaactcttcccggtatccgtaaacctgtcccggcagcatttcaagcgaaatgatttcctgaaccaatttgctgatgtggcagcgaagtaccggatcccggagggattgctggagctggaactgacggaatccatattttttgatgacaacagtatagccatggtcagggagagtatcaaccggatgcatgaactcgggtttaaatgttccctggatgattttggctccgggttttcttcccttgggctgctgaaggaatttgatgtggataccataaagctggacagacgcttcttcctggatatgtcgaagccaaaggctgaagatgtcgtggaatgcctgattgatcttgccgggcggctgaaggtgaagacagtggcggaagggattgagactcaggagcaaatcgatttcctgaaacaaatccattgtgatatggtacagggatttttctattcacggccgcttcgggcggaagaatttgaagaatgggcagacagacgaggataaaacagatcatggagcgcgggcggtttccggctgaatttttcagcaggagacggcccgttatttttattgacggtattgtgtgaacggattgtacttttttatacatatcggtataataacccaaaaagcccaaaacaaagaatgcatgttggtaacttatatttgtatcttggtatcgcggttattgcacaaaacggatttccggatatacttagtgaaagcaggtgacgcaatgatacttaaaacagaacaggatttgacttgcagggatatggaagtcctaatccgatatgcaaaaaggaacaggcggctggaacggctgattaccctgatcaaagcgattgacacacagataaaatgtaatggggaggacggcgaacggctgattgatgcttccgatatttactacatagaaagcgttgataagaagacatttgtctatctggaagaaagtgtctgccgtaccgatttccggttatatcagctgacggatgagctggagcatttgggatttgtacaaatcagcaaatcctgtatcctgaatatcaattttctggaaagcataaaaacgcttggcaacagccgtatggaagccgccctgaaaaatggggaaaggcttcatgttacccgaaaatacctgaacggcattaaacaggcgctgcagggaggtgtaaacatatgaaaaagatggcggttaatattctgtgcagtacgggaattactttaatcgtattggcggccctggggacaatgtacggagcacattatctgtttattaaaagtgttttccagtccttttttgccaatataatcattcatgcggggctgcggctcacccacagatttgaaagcggttatgcggcgctggaatatatgctggatattggatatacgattgctgttgtcattctttgcggcgcggcttttgactggtataccagtacgccggtatggcttcttataatcatgtctgtggttatttacctggcggctgtttctttaagtattttccggatgaagaaggacattgaggaaatcaacgagttagtgaaaaggaggaatcatttgattgattccgggaggatatcaggatgacagaaataataaaggcagaaaagataaccaaggattatggaaaggaaaaggtactcaaaggaattaagctctcggtctgcaaagacacatttacggcgattctcggccccagcggttccggaaagtcaactcttttgaatgtcctttccggcatgatacgccctgatacgggcaaggtaatgtatgaagatgaggtaataacggattatacgcaggcgcagcttgccgattggaaacgggctgaagtgggatatgtcttccagaattatcttctgttgaataatcttacggcagaggaaaatatcaggaccggcatctgtcccggaaaaacgccgctcgcctttgaccggctcacccgtattcttgagatagacaatatcctggacaaattccccgcgcagctttcaggcggacagcagcagagggttgctgttgcaagagcggtgatcaaaagcccctgtctcttgttctgtgatgaggccaccggttcactggatgaagctaacagcaaaaaggtagtggcattgctgcatacattgaaaacggtatttggagtgaccattctgtttaccacacataatgagcagattgcccatacggcagatcgtgcgcttgtgataaaagacggactgctttataaggacatgatgaatgaaaatcccatatcggccgatgatatggtgtgggggtagaaaatgaaacttgtgtgtaaacagctgtccgggcagattttaaaagataaggtttttttgctcctgttatttgtgcttacggcactgacatccctttcttttttctttgtcatgttttcaattgacggaaatatggcggtgctgaacagaatgggaaaactgacggaaaatcagttactgtaccggaatgcgctgcattccaatacgattctggcttacaattttttcataacgctcacagcccttaccgcttttgttttcctcctgtttttttaccggttcttccgggcgaataagaaacaaataggatgcataaaggctctggggtttaaaaacagcttcctgcagaacttttttaccggatttaccgccgtattgtctttcccgggagcgattgccgggatgattggaggatatttcctgtctgatgttttgcttcgtgcgaatgcacagacctacgaggtaaccggcctgacgaaggggctggggatattcggcctgctgaccggctttttcgttcccgctgttgttttttatgtgacagccctgttgtgttacggctttgtgagaaatacggatgcgggaaccctgctggcaggaaatgacagacaggagcgtgtctcatgggcgctgaaaacagccgatacaatcagcagaattatgccttccggcaagaggtttcctctgcggatcgccttgcgcaagccgctgtccgtcctgctattgctcattgctgttatggcatttcaggtatgcattatattggggcagtctctgaatatcagcagtgaaaaggtgttcggcatgcagacggaaggccataattatgaatatgagatacggtttttacggcctcagacagacagtgtccctgaaaatgccgcagcctatctggaaagccccgtaacgctggagcttggaacatatgtactggaaagaaagataaccggcctgtaccagacaggaggcctgtatgagttaaaaaacaggaacggcgagctgctggcggtgccggaggagggcaaagtttatatgaatccggagctttctgaaatatatggggtcaaaatcggcgacaccctgacggttcaaataaaaaacaggccgtatctctttgctgtcagtgatatagccgtaaatgcaaaatccggcagtgtctatataaacggaaaggaactgtccgagatagaaggtgttcccgatggtgcctataacggggtactgagtgcggaggagatgccgggggatgaggtgactgccagagaacagaggatcgatgatttaaacaggaatgcggtttccaataaaataagcgcggtaatcaaccaggccgcaggaattctggcaggcgcaattttgattttcctcgcgctgtatattaattttcaggataatacccgtgatatgctgatactcggcctgacaggataccggaccagggatatccgtaagatgtttgtggatgtttatctgcctgttttgtgggctgcatttgcggtaaccctggttcctgctgtttttcttgcgcggaccatacagcattccctttcggtttccacgaatgactatatgccgttcggcacgaacatagctgtcattctcaccgcgttttgtctgattcatatcatttactggggagttcagataaccttcagcctgggaatcaggagagttacaggaaaacgggacataacagaggtggtgaatgcagaataaaaaggccccttctttatttatcaaaaaaagataaggtttcttcaccgcagaagaacggataaaataaccatacaggaaaaaatatccgtaactgtacaagggggaaatggaatggaaaaaaagataacaatcagagaaaatacggcggaatatatgcaggaactccgggagtgggccggagaggcccgaaagggagggctggaagaaatggcggcctttttccggaacaggctgggtgaatatgaagagcatatgtctatgtggaatgcggcatataaacgaatagggacaatgatcccggaacagacggaaaagctgttggatctgggctgcgggacaggattggagctggatgaaatatcggcggccaggccgttccttcagataaccggaatcgatctgtcaccggatatgctggctgtattggccaataagcacccgcaggtacggcttattcaggccgattatttcagctatgatttcggagcctcggtttatgatatggcagtgtcctttgaatcccttcatcattttaagcaggataaaaagcttgggctctataaacggatatacgaagccctgaaggagggaggaaccttccttgaagccgattatattgcctgttgtgaggaggaggagacgctgttaatggagctgtgtgattccctgagggaaaaagagcatattcctgaggatgtcttcgttcattttgatacgccgctcacatgggagcatgaaagggaggcgctttgcggagcgggcttttcggaagtggaattgattgacagcatagacggggttacctttatcagagcggctaaatgacggactcggagaaggcagattatattataagattaaagccaaagacgctgcattctgcgtttcggtcttttatttccagacagggggacatgcctttttcggcatgccccctgtttcagcgttacaggctcttctgcgtgacaggtcctgccgcagccgcaggaaagattctgacatttaaagggcctttcccaatgcctccgcctgcgcaagctgttccggcctgtcccggatatcccccggatccatattccctccggcgtagacgataccggcgtccttccagcccagatgtgaaagaagcccctcataataagcttttaccggagcaaaattactttccgtgtttccttctgccgccatcagtaagaggcattcttttttcggattttcatagtccggactgcattcggccaccgcgaacaggcggtcaaatgcgcatttcaattgtccgctgatcccccaataatacataggtgatgcgagtaccaccacatcagcctcccggtataccggataaatctgctgcatgtcatccttttgtacacaggggctttccgggttctgtccgcctttacagcagcccaggcagccatggatgttcattttctgcagatcaaagcaggtgacttcatttccggcgctttttgcacctttcgtaaagcattcaatcaaagcctttgtatttccgtttgtcctcggacttccgtttaaaatcacaatctttttcattatatggcacctcctaagtttatgctataattataacgatatataatcctgaataaaagtacgcacatttatgttagatactaacccaaaggagagttaaaatgtttaaagattatctggataagtcaaattttgaagagaccggcttcagctacacactgtccctgataagcggtaaatataagatggtaatcctttactgtctgatggaatttgaaatcgtccgctacaatgaattaaagcgatacataggcacaatttcacacaaaacactcagcacatctctgaaagaactggaaaaagatcagctcatcaaccgcaaggaatatccgcagattcctccgaaggtggagtacagcttatcagaaagaggaaaatccctgatggaaattctggaccaattgtgcatatggggagaaaaaaatagaatttaatatatcaaacggatagatccctcttattttttacgaattaataagtgaaaggagtcaaccaaaggatataaagaaagaggctgcagactctggccttggtttggagtggcgtatgaaagcgaatgaagataattttatctccctgataaagaagcgccgggaagagggaatccggtatgtaatggaagaatatggaggtctgcttcagtccattgtgaagaaaaggctgtacggcatgcccgataaagtggaagaatgtatgaatgatattttcttcggcatctggaacaatatcggttcctttgatcccaaaagaagcagttttaaaagctgggctgccggagtggcaagatttcaggccatcgattacctgcgcagatacggaaaacagctgcagcaggaaagctgggaggaagtggagctttcggcggaggatgagaatctgaaccgtcttgtggagagtgagatttccagagaaacccgggagctgctcgactgcctgaagccaaaggacagggaaatctttgcaaggattttcatacaggatcaggatgtggaaaccgtaagcatggagatgggacttcccagaaccgccgtatataataagatctcccgcggaaagaagaaattgcggagtatggcggaaggaagccgggaataaggagcaggatatggataaaaaaatatataatatggctaacgatatcgttacggattttacagaactggaaagccggaagctgtctgaaaaggaaatcgggaaatatcagcgcagcttcagaaaaagatggaagggcggaagaagcataccggggccgggtaaaatggcggtctgtgcggcggcccttatcctgatagtagggattacggcagcaagcggtgaagtgcatgcggcaatagaacagctgcaatggaccatcagcaatgccctgggcctgcagaaggatttggcggattacaaggaggtggtggataccacggtgatggacagcggctatgccctgacgctgcatgaggtggtggcctcagaggaagagctgtggataaatctgtccgtacagaaggaggacggcagcactctttccctggatgagatcacgccggacgccaaaataaaaatcaatggaaagcggatatatggagggggcggcggaggtattcattatctgaatgaagaacagacggcgatcggcatggaaatgcattataccagtgacggcatggatctgtcgggagtcaatgattaccagatcaagttcagccagctggatatcaagggaaaaatcagaggaaactggacattttccttcacggcggacggttccaccctgatggcggatacacagagggtcacccttgacaaaacctttacccttcctaacggcgtttcaattacattggaggaattcaccagcaacgatctggagcagaggatcctttataccgcggatgccaaagaagctgtggaatacgatttgcttgtgactgctcgtgatgaaatgggaggggaatattctttttacttaagttcctttaacggaagcaggaaaaaaggttatctccgcgcccaggaaacaaggatcccggatggggtcaatcttgtggaaatgacgctctatacggtggctatgccgaaggaaagcgggaaaatgagcaatgatttccagcccctgggagacagctttctgatggaaatcaggtgacatgggagcagcggacgtagtacaatggggacagaccttgaataacagtcagcatgaagaaaggaaaacagaaccatgaaatttacttactgtccggactgcggcaccaaactgatacaaaaggaaatcggggatgaagggctgatgccttattgtgaaaactgtaagaaaccgctttttgatatgttttccacctgcattattgcccttgtggtcaacgaatacggggaggcggcccttctccggcagggatacatctcccatcaatactataatctggtttccggctatatgaagccgggagaaacggccgaatatacggcggcgagagaggtggaggaagaaatcggcgtgccggtggaaaagctgaggtttgtgggaacctactggttcggcaaaaaggatatgctgatgataggctttattgcggaagcgaaaaagagggagctgaagctgtccggtgaagtggatgcggcggaatgggtggatgcttccagggcgattgacatggtgcatcccggaggaagtgtatcctatgcgttgttggaatactacctgaaggaacaggaaagtataaggcagaagggaagctccttatgaaaatagaccgtcttatggcgatcctgaccattctgttaaggcaggagaagataaccgcgccggagctggcggacaggctggaggtatcccgccggaccatcagccgggatctggatgtcctgtgccaggcaggaataccggtggtgacggaacagggctatggcggcgggatatccctttcgccgggctttaaaatagatgcatccctgctgacggaaaaggaaagggatgctctgattacagggatccgggggcttgacagtgtgatgacggcgcccctggccgaagggctgcgggaaaaactgcggatgcttcccggaaaagacacgcaggcgcaggaaacagttaatatcgatctggcttcttattataaaaacagccttaccgtcaagcttgatctgctgaaggcggccatccgggaacaccggcttgtttcctttacctattattaccgcaaaggggagggcaggcggctggcggagccataccgaatcgtttttcagtggtcctcctggtatctgctcgcctactgccgggagcgggaagacttccgcctgttcaagctgaaccggctgtgggaggcggagtgcctggaagagactttttccccgcggacggtgcctgaggaaaagctggatgccttccggcatttcacagatgaaatcaggcttcgcgcccggttctcggaacgtgtgaaattaaggctgattgaagaatacggcccttcctccttcacccgccttgaggacggaacacttctggtggaggatctggggtttaccaattacccggttcttctggaatgggcattaagcttcggaagcaatatcgaggtgctggagccggagcagctcagacaggatatcaggaaggaagcgtcccgaattcttgacagatatgataatccgggggaaacaccggatgggaacgagtaaccggacagactgctgtccggttactcgtgttataattaggaaaaaagggaacagctcaggtataaccggactgttgcaaaaaggagagacagctatggcagccgcagagaagagccgggatgagaataaccggaaagattgggaagaacgggtaattgccctcagaatggaaaggcagcatttgatgaaaccggcgggcttggaggaatataacgtcctttaccgggatttgtctccggggctgaatatatactggcacggattcggagaaccgccctgccttgtttaccgggcaggttttgacgatttggaatataacagggaaaggcagcggaaccgtgaactggtaaaggggcggttccagaaagggaatatcggcttcattcaggaagaagatatggagctttttgcaggcctttaccggaaaccctggaagccggatgatacacaggaattgattctcgcgctgattgacagggaaggcccgttaaatatcggcctgataaaagaaatgaccgggcttttggtaaagcagatcacgccggccctgcataagctgcaggagtcctttgttttatttgaggatcagtttgacggggaatgggatcgggaatggtaccgttttgaagagatgttcccggatgtggatgtacagcattttaccagggaagaagccctgaaaatggtgcttccccgtttccttttccgctatgtgggcgcttctgtaaaaaatttcagggatttttacgggatcccggagcgtgaactgaaggctgccgcggaagaactgacagccggcggacagtttgtacagaaggacgggatttattatcttgccgcggatttcgaacttcttcagaagcaggaacggacgccctttcggaagatcctggtccttcaccggaacgactgcctggtgcggtgcgaggagcatcacctgaagcaggagtacaaaagggagggaatggatattcttcagtatctgctcatcgacggcagaatcaggggcgcggtgctgggacatttcaaatacggcccctatattatggaagatgtatgcgtccggcttccggaaaatgaggcagaagctcgaaaaatggaaattatggaagctatttatgaaataaatggaagagaggagcctatacggcgttatatgggccttccggtataaaatggcagcaggacagtccggcgtattttctgaaaagaagcgccggatttttgttttttgtcaagaaaaattattttttttgaaaaaaataaaaggattccgggtattgacacagaatataaaagatagtgagcttatttttgtccggaaacgggatcggattagagtttcctttccggcatactctgattaagccgattggcagaaaggggacggatgacaacaattcgggaaaatctggagaagtgggaagaggtttatttaagtccctatgctgctctgagcaggaattccctgggaaggctgaaggaggaggaaccctgtgatatcaggcctgttttccagcgggaccgggacaggattctgcactgtaaggcattccgcaggcttaaggacaaaacccaggtctttctcactccggaaggggatcattaccggacgagactgacccatactctggaggtgtcccagaatgccagaacgattgccaaagcgcttcggctgaatgaggatttggtggaggccattgccctgggccatgatttggggcatacccccttcggccatgcgggagagcgggcgctgaaccgtgtctgtccgtttggttttgaacacagcgaacagagtgtgcgtaccgtggatatcctggaaaaggacggccagggcctgaaccttacctttgaggtgcgggacggaatccgaaaccatcagaccaaagggaatccggctacgctggaaggaaagatcgtaaggctgtcggataagatcgcttatatccaccatgactgtgatgacgctgtccgcgccggcatcctgagagaagaggatattccggcttcggtgcaggaagtggcgggcaggaccacaggcgaacggctggatcattttatccatgatattgtgacgaacagcttcggcaggaatgacatttgtatgtctcccccggtggaggaggctatgaagacactgcgggcttttatgtttgaacgggtttacaccaataagcaggccaaaagcgaagaaagcaaggcggagctgctggtggaaacgttatatgattattatctccatcatattgataaaatatccacagaacttttggaactaatggaaagaggggaagcgaaggaaaggatttgttgtgactatataggggcaatgacggatcggttcgccattgcacagtatgaggaaatttatattcccaaatgctggacagtgaaataagcaggcgaggtgagtgaaggcatgtattatcccgatgaactgatagaagaagtcaggatgaaaaatgatattgtggatgtgatttcaggctatgtgcgcctccagaaaaagggggccaattattttgggctgtgtcccttccataatgaaaagtcgccttccttttccgtatctcccggcaagcagatgtactattgcttcggctgcggcgcgggaggaaatgtgtatacctttatccaggaatacgaaaactatacgtttccggaggccgtcaaaatgctggcggaccgtgcgggtgtgaacctgccggaaatcgagtattccgaagaggccagaaaagcggaaagcaagcggagtaaactgctggaaatcaacagggaagcggcaaaatatttttattttcagctccgggccaaacagggtgaaattgggtataactacttaagaaaccgtgagctgacagatgaaaccatcaaaaagtttggtcttggctttgccaataagacaagcaatgatctggtgcagtatctgcgcagcaaaggctattcccaggagctcatccatgaggcaggattgtgcaatgtggatgaaaagcatggcatgtatgacaagttctggaaccgggtgatttttcccattgaggatatcaatcaccgggtaatcgggttcggcggcagagtgatgggggatgggactcctaaatacctgaattccccggaaactcctgtttttgacaagagcaggaacctctacggactgaattttgcgagaacctcccggaagggaaacattattttgtgcgagggctacatggatgtcattgccatgcatcaggccggctttgatcaggcggtggcgtctctgggaactgcgttcaccataggacaagccagtctgctgaagcgctatgccaaggaagtgctgctgtcctatgacagcgacggcgcaggcgtgaaggcggccctgcgggctatcggcatcctcaaggaggccgggcttacagggaaggtgatcaatctggagccctacaaggatccggatgaatttatgaaaaacctgggaaaggaagccttccaggaaagaatcgaccatgcggaaaacagctttctgtttgaaatccgcatgctggagaaggaatttaacctgtccgatccggaggacaagaccaagttccacagggagattgccagaaagctgtgtgaattttccgaggaagtggaacgggagaattatattgaggcggtggcggaaaaatatcatataggctttgagaatctgcgcaggcttgtgggaaacaccgctgccaaaaccggtctggccaaaccgatggagcgccccaaatccggcatacagaaaaaaacgacgcctgaggaaaacagcaggaggacacagcggctgctgctcacctggctggtggaagagcctcaggtataccctaagatatcccgcttcctgtctgccgaagactttacggaggagctttacgtaagagtggcggagaggctgtttgcgggcctggaaaaaggagaactgaatgccgcatcgattatcagcctgtttcccgatgaggaggaacagcgggaggtggcctccctttttaatacaaagctgttggaaccagaaacattacaggaaaaggaaaaagctttccacgatatcctggtttccgtaaaaagaatcagttatgaatacaataccagccgtctgggaacagatgtagaggcgttaaaccgcgtcattgaaggaaaaaaggcgctggaagaacttagcaaaacgcatatttccctgaattaaggataacaatattaacatgcgcaggaaggatggacaaagaatgggcaaaaagacacaggaaaaagcagatgaggcaaagaagacaaataccccgaatgaaaccgaaatgactccggaagagaaagccgcggcggaagccaagtttctggaaagggtaagaggccttatcggcgttgccagaaagaagaagaatattctggagtaccaggagatcagcgattattttgccgatctgcagctgaatgaggatcagtttgataaactgctggagctgctggagcagagtaatgtggatgtactgcgtattacggaggatgacgatgatattcccgacgaggaaatcattctgtctgaagaggatgaggtggatatggaaaatatcgaccttaccgttcctgacggaatcagcattgaagatccggtgcgtatgtatctgaaggaaataggaaaggtgcccctgctttctgcggaagaggaaattgatctggcgcagagaatggaagtgggagatgaggaagccaagaagcgtctggcagaagccaacctgcgtctggtggtcagcattgccaaaagatatgtgggaagagggatgctgttcctggatctgatacaggaaggaaacctgggcctgattaaggcggtggaaaaatttgactacaccaaaggctataaattctccacctatgccacatggtggatccgtcaggcgatcaccagagccattgccgatcaggcgagaaccatccgtatcccggtgcatatggtggaaacgatcaacaagcttatccgtgtgagcagacagctgcttcaggagctggggcgtgaacctactccggaagaaattgcggaagaaatgagcatgcctgtggaaagagtccgggaaatcctgaaaatatcccaggagccggtatctctggaaacgcctatcggtgaagaagaagacagccacctgggcgattttatccaggatgacaatgtgccggttcctgcggatgcagcggccttctccctgttaaaggaacagctgaacgaggtgctgggtacgctgacggaaagagaacagaaggtgcttcgcctgcgttttggcctggatgatggaagagccagaaccctggaagaggtgggcaaggaattcaacgttacccgtgaacgtatccgtcagatcgaagccaaggctctccgcaagctccgtcatcccagccgcagccgtaagctgaaggattatctggattaaggaaaaagaatatggaattgtcaaaaagacttcatatggtcgcatctatggtagaaaaaggcagtataccggcggatgtgggatgtgaccatgggtatgtggcgatatatttgatccaaaacgggatctcaccccatgtgtttgccatggatgtgaacgaaggccccctggagcgggccagagagcacgtggaagaatatgggcttgccgcatacatagatgtaaggctttccgacggactttccggccttccctgccgcgggggaaggccggaagcggatacgctgctggcagcgggaatgggaggcaggctgacggtgaaaatactggaggaaggcgcagagaagctggcagggatgcgctgggtcattcttcagcctcagtcagagccctggctggtgagaaaatctttaagaaatttaggatatttcattacagatgagaatatgatttgggaagaaggaaaatattatgctgtaatgaaggctgtgaatctcaggaatctgccggaaggcttccctgtcggcaggcttgaggaggaggcccgcagttttttcagaaaccggccggtattttcggaaacagaatgggaacaggccggggacagatacggctcctggctgctcatccgccggaatccggtccttttttcatatctggaggattgtctggacaaaacagccggcattctgaaggggattgacggacaaaaggatgatgcaggatactcggataagaccggaaagcggcttgcgcagctgaaggaggaacagcggctgctggaacagctgcttatgctgtataaggagaaaagcctatgaaatgcagtgagataatggcgaagctggaagaactgtcccctctttcctttgcggaaagctgggataatgtggggcttcttgtcggaagccgggaacgggaagtggaatccgtaatgattgcgctggatgccacggacgcggttattgatcaggctgtgctggcgggagcggatatgctgctcacacatcaccccctgattttttcgccccaaaacaggataacggcggaggattttaccgggaaacggattatcaagctgatagccaacgatatctgctgctatgccagccataccaattttgatgtgatgggaatgggggatgaagcggcggaacgtctggctttggaggaacgcagtgtcctggagatcacctttgaggatgagctttcccaggagggaatcggcagagtgggcattctgccggaatgcatgacgctgcgggaatgcgcctcctatgtaaaagagacctttgacctggatacggtgaaggtgttcggggaagaagacaggaaggtccgtaaggccgccgtggtgcccggagcgggcaaggattatatccgccaggcggtaagggcgggcgctgatgtatatattaccggcgatatcgggcatcatgacggaatagacgcgttggaacagggactgaccattattgatgcgggacatttcggtgtggagcagatttttgttccctacatgaaggaatttttaagcagggagcttccctcgctccatcttttatccgcaagacagcaggaacctttttggtatgaatagtcatgaacagaggagtttgaaatatggttaaagtaacggtgaatggcacatgcagagaatatgaagacggaatcacctatgaaacactggcacaggaacatcagcaggaatatgaacacagaatcatccttgccgttgcgggagggaagatcaaggagcttcataaaaaggtggataaggatgtaaccgtcactttccagacactttcagacagggtcgggcatgatacttatgtccgcagcgccgtgatgctgcttataaaagccatcagtgacgtggcgggatctcccgaagagggtgaggtatccgtggaattcacaattggccgcgggctctattgtgttcctaaaggaagactggcggaacgggtggtgatagcagacggggaagaagagcggcagatggaggccgaattcgttgacagggtaaaagaacggatggcggaaatggttgcggccggtcttcccattaccaagaaggcttatcccacggacgaggcgatcgcacttttcgaagcacagggaatggatgataaggtcaggctgttccgctatcggagaggctcttatattaacgtttactgcctggacgggtattatgattataattacggctatatggtgccggataccagctatctgcagtatttcgatctccttccctataaggagggaatgattctcatgcttccggatcgctgggatccggagactatgggcagctttgaacccagggaaaagctgttccataccatggagcgttccaattactggggagaacaaatggggattgagacagtggcagatttgaacgacaagatctgcgaaggagatcttgcggaaatgattctggtgcaggaagcgttccaggaacgccggattgctgaaattgccggagatattgcaaagcgtgacaatgtaaaatttgtaatgatagcaggcccttcctcttccggaaagaccactttttcccacaggctgtccattcagctgaaaacacacggactggtgcctcatcccattgcggtggatgattattttgtggatcggaaaaatacgccccgggacaaagacggcaattataattatgaatgtctggaagccatagacgtggaacagttcaacagtgatatggctgatctgcttgcgggaaaaaaggtggaaatgccccgttttaattttaaaacagggctgagagagtataaaggggattatctgcagctggggccggaggatattctggttattgaaggaattcacgggcttaacgatcagctgtcccattcccttccgctgaagagcaaatataaaatctacatcagtgcccttaccagcctgaatgtagatgaccataaccggatagcgacgactgacggcaggctgatccgcaggatggtgagagatgccaggaccagaggggcgtctgcgacccatacactgcgtatgtgggcctccgtgcgcaggggagaagaggaaaatatctttcctttccaggaaagcgcggatgccatgttcaattccgcccttttatacgaacttgccgtgctcaagcagtttgcggagcctttgctttacagcgtgggaaaggacgaaccggagtattttgaagcgaaaaggcttcttaaattcctggagtatttccttggggtgagcagtgaaaatctgccgaacaattcgattgtccgtgagtttgtcggaggcagctgcttccgcgtatagacaagctgtggtgtgtgggccttgtgtcccgtcccggcagagggtgccgtctcctggctgcttccgcggcaggcaagggtatataggggaagaagggtatgtttgaggttgaggtgaaggcgattctttccggggggaacggaatgaatctttatagagggtgtactcacgggtgtatttattgtgatgcgaggagcagctgttatcaggtgcatccggacagaccttttgaggatatcgaagttaagcggaatgcggcggagctgttggagcaggctttgcgggggaagcggaaacggtgtatgatcggtacgggtgggatgagtgatccttatctgcatctggagaagaggctggggcttacgcgcaggtgtctggagctgattgatgaatatggttttggggtggctatacagacgaagtcggatttgatattgcgggatttggatttgctgaagcgtattaaccggaagacaaagtgtgtggtgcagattacgctgacgacttatgatgaggatttgtgcagggtgattgagccaaatgtgtgtacttcaaggaggcgggcggaggtgcttgagattctgcgggatgaaggaattcctacggtttgctggatgacgccggtgcttccttttatcaatgatacggaggagaatatcagggggcttctggagtattgctgccgggctaagacttatgggattctcacttttggtatgggggttactctgcgggacggggacaggcagtatttttaccggaagctggatgagcattttccggggcttcgggagaggtatgtgaagacctacggggatgcttatgaggtcccttccccgaatcaggcggagcttatgaagcttctgcgcagggtgtgtaaggagcaggggattgtctgtgatgcggatgaaattttcaggtatctgagccggtttgaggataagctggcgggaacgcagatgagcctgtttgatttttagggttgtcaagcgggaggaaaaaagatatagtataacatggaaccaggttccatggaacaaagttccacggaaaataagtaagatgaataatcgcggctgcttatgccttcgggctgcggcaggtgaggaaagtccgggcttcgcagggcaggatgccggataacgtccggtggaggtgactccaaggccagtgcaatagaaatataccgccccgccatcggcggaaagggcttcccttaggggaatgcctggtaagggtggaaaggcagtgtaagagactaccgcccgtctggtaacagacggggcatatgtaaaccccatccgaagcaagaccaaacagagagcgacaggcttgcccggcctgctttcaggtaggtcgcttgaggctgccggcgacggcagtcctagatagatgattattctcgacataacccggcttacagttttgcttatttccgtggacagcgatccaaagggatgtatttggatagaaccagaggtttattatccatttggcgattgccgcgagggttgaagatccggtcagcttgctgcaggatatttgacgttcaattgagtccggatctcatatgagtgggtatccggcttccttcaggaagaacaggcaagtgtcctgttctttttcgttcttatgaaaagcatatgggctatggtgagggttaacaaagccgcggtttggacgggcgaatgggagtatagatgaaaagtatgggtaaatgggggatatgtatattgctgggagcagcagccttgctgctgggaagctgtaaaaacagcaggatggagccaatggaagagaaagaaagcctgaatgaagtagtgcagggggaggaaagggattgggtcgttttttcggatagcctggagggggagaatgaggaaaaggcgcgtgagatagcggtacagagtattgtaaggctggaaacggaaaagaatggcaatgtctattttggcagcggtatcatctgggacggagatgaggaacgtattgtgatagtaaccagcgggcatctgcttgaggaagggcggcttctcggtgttatttttccggggggaagggaaacgtccggtgaaacggcggggatctgcggacagaaggatttggcgttcgtgacggttccggtaagctggttgggagaggccgatcagaaagcaacggtggtcagcctccatcagcggatttttgaaacgctggacggcagcagtcagctgctggtgcttggctgttctgaaaatggcgtcggggatcagctcagaagagggacattgaaggagaaagcctggtaccgtgaggagttcggggcggatgtcatggtccttgagtgcgaatcgctgccggggatgtcgggcggaggcatatttgactgttacggaaatctggtgggaatgctggaaggcggcagcggaaacagtacggtcgctttttccatggaaacaataaatgagggttatgaggaagtattcggagtaaaaagaaatacggaagattataaatgacggcttttgcgggagcaggaatccgtacttaataaaaattttatcattaaaacgggaatcgccgggcgtgctgtggttgacaagtgaaggaaaacggggcaaaatatagaggatgtctttttcgcttcggacagggaagagacagatgattgcttttaaataacaggccgtaaaggatccgggtttgccgtgagcagggaattggtgtttttggcaggccggccagccggaacggagaaagaggtgtaatatgacaaaaatagatattttctcaggatttctgggagcaggaaagacaacattgattaagaagcttttgaaagaagctctggcgggaagccaggtagtgctgattgaaaatgagttcggggaaatcggtatcgacggcggattcctgaaggaatcgggcatagaaattaaggaaatgaattccggctgtatctgctgttctctggtaggtgatttcggtacctctctaaaggaggttatggataaataccatccggagagaattcttattgagccttcaggcgtaggcaagctttccgatgttatcagggcggtacagaatgtggatatgggggaagaggtcacattaaacagcgcggttgcggtagttgacgcctccaagtgcaggctttacatcaagaatttcggtgaattctttattaaccagattgagcatgcaggaacgattatcctgagccggactgatgtagcctcccaggccaaaattgagcaggcggtcgccctgatcagggaacataacagcaaggcgactattattaccactccgctggagcagctgaacggtaaggatattctggaaaccattgaaggtgcggcggatctggagaaggagcttatggaggaagtgctggaggagcatgaacatcatcatgatcacgaacaccatcatgaccacgagcatcaccatgatgaagaatgcggctgtcatgaccacgagcatcaccacgacgaagaatgcggctgccatggccatgagcatcaccatgacgaggactgctgcggccatgatcacgagcaccatcatgacgagaactgcggctgcggtcatgaccaccacgatcatgacgggcatcatcacggagaggaatgcagctgcggctgcggtcatgatcatcatcatgcagatgaagtgtttaccagctggggaatgcagacgcccgcttcttacacccaggatgagatatccgggatcctggaagagctggaagatgaaaagaaatacggttttgtgctccgggccaaaggaatggtgcctgcgggggatgaaacctgggtatactttgattatgtacccggcgaaagcaatgtgagggaaggaaaaccggatgtgaccggtaagttctgtgttatcggttccgaactgaaggaagacgccctggcggagctgttcgctaaaaagaattaaatacgcccttggcggttctatttttacgaaaggcaggatgcgtgctgtgcgcatggatgggaataaagaatgaaacctgtatatattatcaatggctttttggaaagcggaaaaacggaattcataacctatacgctggatcagccatattttcagataaaggggaaaaccctgatcattctctgtgaagaaggagagaatgagtatgatccggcgctgctgaaacgcagcaatgcctgtttggagctgatggaacaggaagaggattttacgccggagaagctcctggagcttgagaaaaaggtgaagccggagaggattatcattgaatataacggtatgtggaattttaagaacatgaagcttccctggcattggcgcgtggagcagcagattaccacaattgacgcctccacctttaccatgtattttaccaatatgaaatctttgcttgcggagatgctgcgcgcttcggaaatgatcattttcaaccgctgcgacggcattgaggatctgaacagctataagcgtaatgtaaaggcgatcaaccagcaggcggatattatctttgaggacagcaacggggaaatcgacgagatatttgaagaggatcttcccttcgatttgaacagcgatcccattgtgctggacgacatgggctatggtatctggtatatcgattccctggatcatctggatcggtatgtggggaaaaatgtgcagtttacagctatggtgatgaagccggatggttttcccaaagacaggtttgtgccgggccgtatggctatgacctgctgcgcggatgatatggcatttctcggtttcgtctgcgtttccggggaagcggaaaaattccgggggcaggactgggtgaaggtgaccgccagggtggaaaaggaattctgggcggattacggcggagaagggccggttctgcatgccaccagtgtgctgaaggccaaggctcccaaagataaagtcatcagtttcgtttaggagataggaatgtcggcggaaacagataaggacttgctgcagttaaagaagcgttttctggaactggcagaaaagtcatacgcacagaatatatatacctttacgggcttcctgtccatggcagagcaggaagctctatttgaggcgatgcagaaaaataaaagctataccttcagcctttccggcggaggggaaggctgtgaaagacagatggcaagattcggctctccggaagaactgggatatgaggagccttttcctgttgaggttctgaaaatcagtcctttgctggagaaattcgcggataatttcacccacagggatttcctgggggcggtgatgaatctgggaatcgacagaagtacggtgggagattttttcctggaggggaaaagcgcctggctttactgtacacagcggatagctccttatatctgtgagaatttgaataaggtgaggcatactaatgtacgctgtgaaatcgtggagcaggggatggagctcccggtgagggaaccggagaaaatttcgctcattgtttccagcgaacgggccgatgccgtactggcaaagctctggcagctgtcaaggaaccagagccttgaattattccggacgaaaaaagtgtacgtcaacggaaggttgtgtgaaaacaacagctgccagctgaaaagcggcgacagggtaagcaccagaggctatggaagatttctttattatggcgcccttggggaaacaaggaaaggcagactgaatgtttccgcaggcgtataccggtaaaaggaaaacaggggaggaatttttggatgtatcattatacgttatcgcagtggatcttctttttctatttttactgcttcttcggatggtgttttgaatcaacctacgtatccatttgtcagaaaaaactggtaaacaggggatttatccgcgggccgttccttccgttgtacggttccggcgcaattatgatgcttctggtttccagccccatgaaaggaaacctggtggggatatttatagcgggctgtttaggtgccaccgtgctggaatatgtgaccggtgtgattatggaagcgctgtttaaggtacgttattgggattactctcataagaaatttaatttcaggggacagatttgtctggagtcctccctgtgctgggggcttcttacgattctgatgacccagttcatccataaaccggtggaaagtcttgccatgatgattccgccaagagttctggtgctggctgtggcggtcatatccgtactttttatcgcggattttgttacgtccttccaggctgccatggatctgcgggatatccttattaaggcagagcaggccagacaggagctggagcgtctgcagaagcgtctggatgtaattattgcggtggcgaataacgatcgggaaataaaaagggaaaaacgggaagagcgcatggaagaacttgcgtctgcaatcgaggacaccttccttcagctcagggatgcaattcccggttccgagctgcttcgggaaaagatggaagaaattgtcgaactgcgtgataagtttataggcagcaggcgtgtcggggaggaaaaccagcagtcctttatccacagctttttcaagagaaatttgttaaagggtaatccaaccatgacttcccataaattctatgacactttggaagaattgaagaagtcggcttctgaatacagaaaaggtaaaaaatgaaaaagaaacggacaggaatcattttttctgcgtctctgcttctcctgctgatgctgacactgtatggctgcggccggaatgcacagcaggaggcggcgcaggaaacagctcctgacggcaggccgaaggtacaggtaataacgactatctttcctccctttgattttgtccgccgtataggcggcgaatatgtgggagtgaatatgctgctgaagcccggaatggaagctcattcctatgagccttcgcccagggatatcatccggattacggaaagcgacctgttcctctatgcagggggcgaatccgatgtgtgggtggaggagcttcttgccggaaatgatggggatgtatattcgcacagccttctttcctgggtggagcctcttgaggaggaaagcctggaaggaatgcaggtaagagggcatgatcacgaggaacatgaagaagaggagggcgtccatctggagcatggggaatatgacgagcatgtctggacctcgcctgccaatgccattcttcttgtggaaaaaatcagagacaccctgatctccctggatccggagagaaaagctgtttttgagaaaaatgcggaggcttatctggcagaactgagacagcttgatcaggattaccgtcagatggcggaaaacgcaaaacgccatacactggtattcggagaccgttttcccttcctttatcttgtgaagaattacggcctttcttattatgccgcttttccgggctgcagttcagaaacggagccaagcgcggctacgatagcttttctgacagatgaagtggagcacgaacagattccggtggtattccgtctggagatgtccaatggaaaggtagccgaagcgattgcagaggtgacgggaaccagaacagcggtgcttcactcctgccataccctgaccagagaagagatggagcggggggagacttacctgtctttgatgagacaaaacctggagcagctggacaaggctctcaacgaatgaagggatagagattatgtcgtatatcatctgcaaggatgttgcttttgcatatgagaatcagatcgtggtgtccggactgagctttcaggtggatgccggggattatctgtgcattatcggagagaatggtacgggaaaaaccactttaatgaaagggcttctgggtttgaaaaagccttacagagggacgattgttaccggagacgggctgaagagcgcggagattggctatgttccccagcaggatgcggtacagagggattttccggcctcggtgtatgaggtggttttgtccggatgcctgaacagcagaggaatgaagcccggtttcggtgcggaggagaaaaaaagggcgcttgggaatatggaactgctgaatatcagcggactgaaaaacaagagcttccaggatctttcaggaggacagagacagagagtgctcctggcccgttccctttgtgctacgaaacgactgcttctgctggacgagcctgtaacagggctggatccggtggcggctgaggaattctatggtgtgctggatgctttgaacggaaagcatgggattacggtcatcatgatttcccacgatatcagggaagctgtggagcatgcggaccatatcctgcatttatcccatgggggatattatttcggaaccacacaggattatgagaagagcagtttgggaaaaaaatttctgggaggtctgacagatgcttgaatacattgggagaatgttttcttatccttttatgcagcgggcatttctggtaggaattctggtgtcgctgtgtgcatccctcctgggggtgagcctggttctgaagcgctattccatgataggggacggactttcccatgtgggcttcggggctttggcggtggcttcggcgctgcatatggctccgctggcggtcgccgttccggttgtggtacttgcggcttttatccttctgcgtctgagtgacagcggaaaactgaagggggacgcggctattgccatgatttccacgggtgcgctggcggtcggtgtgatggtggtttccgtcacgacgggaatgaattcggatctgaacagctatatgttcggttccatattagccatgagcaaaagcgatgtggtgctgagtgcggtgctgtcggttattgtgcttgtactgtatttgtttttttatgataagatctttgcagtgacctttgataccgtttttgccagggccacgggaatccgtaccggactctacaatatgcttctggctgtgctgacagcggttacggtggtgctgggcatgcggatgatgggagcactcctgatttccagcctgattatcttcccggcgctgacggctatgcgggtctgcaaacattaccgcagtgtgatcctttgtgcggtagcggtttcggtcatcagcttcgtgctgggaatgacggtttccttcctgctggcaactccggcgggagcgagtatcgtgattgtggatattgctatgtaccttatattctgggcggcgggggccattcgggggaggctggcatagggcggcgcccagccggtaaaaatgaattttccatacgattataaagaaagagccggtatccgatgccggtcagggaacatatccctgaccagaggcatccggagataccggctttttatatattttcgcagatacggatatccacagtggtgtaatgatattctttttccggtttttctcccgtggtcaggcaggagaacatcagatccagcggtttggtgccctggataagaggctgctggcagatggtggcggcgataactccctgaaggaccatttccctcgtggtggaaaccttatcgcaggaaataatggtgatatccttcctgcctgcggcgagtaccgcccggcagccgccatagacgccgcccgcggcgaaatagaggccgttgatttccggatgctcctttaaaagacgcagcgtgcgatcatagctttcaaattcatcgtcactgttttcaatggtgtcaatgatccggattcccggataatgggactggatccggtcccggaagccggcgatacggtccgtatggcagagaacctttgaagagccggtgacaatgccggcatagacctcatcccccgcaattaagtgcataaggcctgcagccgtttctccggaacggtagaaattgcagcctacataggcgagcctgctggaattctcgatgtcggtattggtggtgatcaccggaatttcccgcgcattcagttcatttatcttatcacagatgagaggatcattatatggagagagcacaatgccgttgactccctgagaaaccatttcatccatggcacgcagctgagcctccagatcaaaaccgactctgctgacgaggacggaacagttatagccgccaagttctctggatttccggttcacgccctccaggacatcatcaaaaaacggatttcccgtatcgaaaaggataacaccgattttcagattttttttctgggcggcaaggacaatgcctgctttatttggtttataatcaagggcctgggctatttccaggattttcctggcggtgcggggattcaccgatccacggttattcaggacgcgatccaccgtacctcttgagacaccggccagttcggcgatttcctttatggtagccatctcttgttcacctctgcttccgatttattcctgcgatcattctcattaaccgtatcataaataagaggcaaagtcaatttgagaactccggaaaccgtgtgcgtgcaacacgaaacggcagaatcaacaaaaaaggaagcgaagaaccccttaaaacaaaggtgaattgtgaatttttacgaaatttacaaaccccattgatttttagatgaaaatcatttatcataaaagtaacgtgcacgggcacgtaagacggaacatagagagcggccggcatcaggttcttaagaaatgaaagaggggacagcggctgcggatatgtaaaacaggcaaacaggagaagaaaggacgggaggcgcaaaaatgttatacataggcgtggatcttggaacatcggcggttaagcttctgctgatggatgaaaagggagcgatcaagaagattgtgtcaaaggaataccctttgtttttccctcatccgggctggtctgaacagaaaccggaggattggtttgagcagaccatggcaggattaaaggaactggtatcggattgtgacaaagcttcgattgcgggcatcagcttcggcggtcagatgcatggactggtggtactggacaaggaggataaggttatccggcctgccattctttggaatgacggaagaaccggcgaggaaaccgactatctgaaccaggtgatcgggaaggataagctgtctgaatatacggcaaatattgcgtttgctggctttacggcaccgaagattctgtggatgaagaacaaagaacctgagaattttgcaaaaatagaaaaaatcatgctgcctaaggattatctggcatataagctctccggcgttcactgcacggacgtgtccgatgcttccggcatgctgctgcttgatgtgaagaaccgctgctggtctgatgaaatgtgcgaaatctgcggaatccgtaaagagcagctggctcagatctttgaaagctatgaagtggtgggaaccctccttcctgaaattgcagaagaactgggactttccgctgatgtgaaggtaattgccggtgccggtgacaatgcggctgccgctgtgggaaccggtactgtaggggatggcatgtgcaatatctccctgggaaccagcggaaccatttttatatcctccagaagcttctgtgtggacagcaataatgcactgcatgcttttgcgcatgcggatgggaagtatcatctgatgggctgcatgctcagcgccgcatcctgtaataaatggtggatggatgatatcataggaacctccgattatgccaaagaacaggcggagattacaggacttggtgaaaaccatgtattcttccttccttacctgatgggagagcgttctcctcataataaccccaatgcgagaggaaccttcatcgggatgaccatggacacgacaagagccgacatgactcaggctgttctggaaggtgttgccttcgcgctgagggattccttcgaggttgccaaatccctgggaattcatattgaaagaaccaaaatctgcggcggaggagcgaagagccctctctggaagaagatcatggcaaatgtgcttggcattaaggtagatatgattgaaagcgaggaaggacccggctacggcggcgctattctggcagcagtaggatgcggggaattctcaagcgtggaggaagcggcggacaagctggttaaggttgtgggaacggtggaacccgatccggagctcaccgctaaatacgaagagagataccagcagttcaggcagatttatcctgcatgcaaggagctttttgataaaatcatttaataggtaccggtgagaaagctttaccgggcagctgctattttcaagtgtttccaatgccgataacagatggctggaagttaaatggatgaagaaaaggaaaggaggaaagaaggatggaaattaagaaagtaacggacgctgcattccgtaaatacggaaaagtagtgaaaaacgtggactttacggctcttgtggaggaactggaaaagactccctgcaccgcagaggtggtatatgaacccagtgttcctgagctggaagctcttcctgtatataaggagcttcaggatgtgacctacggcgagatgcctattcagattggattctgtaatggaaacaattataagctgaatgctttggaatatcacaggacatctgaaatcgatgtggctgcatcggatctgattctgctgcttggctggcaggcggatgttgaggaggactatacctatgacacctccaaggtggaagcctttttgcttcccaagggagttgcggttgaactgtacgcaacaaccctgcattatgcaccctgcaacagcggggaaggcggtttccgctgtgcaatcgttcttccggacggaaccaatcttccgactgacgagaaccacttcgccggcggagaagatgcactgatcacagcgaagaacaaatggctcatcggccatgccgagggcggtcttcctgaaggatgccatattggccttaagggagaaaacatttctgtgaagtaattttaagtgcggccgttggccgcggaaggagaggaaagacatgaataacatgccgaaagaaaaaattgctatcgtagcggtaagccgtgactgcttccctatggatttatctgtatccagaaggaaagccgtagttgctgcttataaggaaaaatacggggatggcctgtatgaatgccctgtatgtatcgaaaatgaaatcgatatgagaaaagcactggctgacgtaaaagaggccggctgcaacgctatcgttgtttatcttgggaacttcgggcctgagacaccggaaaccctgctgatcaaggaatttgacggaccggctatggtggtagctgctgctgaagagaccggagataatctggtgagcggaagaggcgacgcttactgcggcgttctgaatgccagctataacctgaagcttcgtaacctgaaagcatatcttccggaatacccggttggaaccgcttccgaatgtgctgacatgatcgctgaatttgcacctattgcaagagcggttgttggacttaagaacctgaaaattatttccttcggtccccgcccgaaagattttatggcctgcaatgctccgattaagcagctgtttaacctgggtgtggaaatcgaagaaaactccgaactggatctctttgaagccttcaacaatcatgccggagatgaaagaattccggaagttgtaaaggatatggaagaagaactgggtacaggaaacaagaaacccgaaatcttatcaagactggcacagtatgaactgactctgcttgactggattgaagaacataagggaagccgtgaattcgtagcggttgccggaaaatgctggcctgcattccagacacagtttggctgcgttccctgctacgtaaacagccgtcttaccaagagaggaatcccggtttcctgtgaggttgatatttacggagcgctcagcgagttcatcggaactgttgtcagcaatgacgtggttactctgcttgatatcaacaatacggttcctgccgatatgtttgaatccgatatcaaaggaaaatacaactatacacagaaggataccttcatgggcttccactgtggaaataccgcttccagcaagctgtccttctgcgagatgaaatatcagttcatcatggctagaagccttccggaagaagtaacccagggtaccctggaaggagatattatccccggagatatcaccttctaccgtctgcagagcacagcggattccaagctgcgcgcttatatcgcacagggtgaggttcttcctgttgcaacccgttccttcggcggaatcggcgtattcgcaattcctgaaatgggacgtttctatcgtcacgtactggttgagaagaattatcctcaccatggagctgttgctttcggacatttcggaaaaacactgtatgaagtatttaaatatatcggtgtggaaatggatgaaattaacttcaatcagcctaagggaatgatgtatcctacagaaaatccttttgcctgaaaaaatgcagtttaagttctgaagtacaaaaacggatgctttggtgtccgtatgaaaacagcggatgccgcgctctgcgggccatccgtatgttaaataaaaaaccacaggatctgctttcgcgtggggtggcgcagaaagcttcctgtggtttttcttgtgtttaattacgtaatttgagcgcctgaataattaaatcataaacaatccgctgctccttcggagataattcagctacgagatacatgatacggtccggaatatagtccacagcctttgcgccggaactggtgatgttgacaaaaagctgatcgatgggtatttccagcccgtttgcaattttcatgtcgctttcaatggtggggttcttttcgcctctctccagctgcccgatataggtagggtgaagactgcatttctctgccagctcttcctggcttaaacgcttttctttacggaatccccggatcctggtgcctactaattttgtaatattatccatggttttgccctccctactaaagactataaatatggaagttatctttcaatatgctaataatatttattgtttcggaatgtgtattaaaaatattaatctcattcttttatatacaataaatatttgcacagggaagagcggaaaagaaaaaacagagtttttggagattccaggaagctttcagggagaaaaaatcaggaaggagcctcccatgtctttttatgacatgagaggttccttcccggatagctttcagaatctatagattatgagaattagtaaataatcagctctgcttatcggcctcctcatcccaataagggcagctgtgcccgatgacagaggaatcaaaggcgcttccgtcattctttttataatgtgaggttgccttgaatacatatttagcgcccagataaagaagcggaacattggcgaatacgattaaaatattacccaaatcggatattgcccacaggttccccaattcaatgcctgcaagggaacaggcgatgccgaaggctgtgatgataattcctatgattcgtaccgtgtaaataacacgtttccgggagctgatacggttagccgcaatttcactgaaggaaatcattcccactaagcaggtgaatgcgaacagacagaagcagaaggtgagcaggaatgcaacgactgcattcatggcggtgcccggcgtaagcgccttggcagactccaggaatttgggaagtctgtccagagcaaaccatgcttcggcttcgctgccggtccaaacgtgggccatgactaccacgaaaccggtaagcgtacagataaccatggtatccagaaatacgccgattgactggacacatccctgttcacagggatggttggtattcgccgcgcccgccgccatggtaatggtaccctgcccggcttcgttggacatcagcccgcgcttaacgccctgtacaagaacggttccgaacacaccgccgaatatggcctgaggggtaaaagctcccccgaatacagcccccagaaaatagggaacagaatgcagattcagaagtatcagcacaaaaacgacagccacatatacaacggccatcacaggaaccaccttatcggtgacttttgtaactttacggattccgccgaatgcgatataagccgtcactgcgatgagcagcagggctaccacatagtaaaataccgaagtgtcctccagggaagcgccggtggtgatttccaccatctgtccgatggagctgactacgttaaaaccctgggcgggaagacagcacatggcataaatgatatacatcagggaaagtgctatcccggcccaaagcttgttgcccagcagaaccttcccataaaaaggaagcccgcctacgaattcatcctttttcctttctttaaaaatctgggccagtacggcctccgtataggcggtagccattccgaaaaaagcggaaacccacatccagaacaacgcgccgggcccgccgactgcaatggctcccgttactccgagaatatttcccggccccactcgcatggcggaactcaggaaaaaagcagccagggatgagataccgatctcatctctttttttctgtgccagtatccgtatgcctttaccgaaatgagttacctggataaagcctgttttcagggtgaaataaatgcctgatccgataagaagaatcaccgcaagggaaaaattccccaggatgggaatggatgcataccagctgaaattggtgggaaaatcccaaaagaagtcggaaacggggatgacgaagtcgaaaatattattgattgcctgaaacagatgttccatatgtactccctccttgcaatgcctgagattgtttgtgcctgcactaaaagccttttttattattatacgaagagtggagcggattaaatacggaaaaagaactgtttatattgtaaattgtgctggtgtctggagaggaatgggagtataaacattctgaaggcggatcccaaaccaatttggagcgaagtaatccatatttattttatgacagtttgtgtttgtttatcagataagaaatttgttccccgcaggacatcatgaactaaaatttctatggctcggtctgattcttcccatagaggactgtgcgcggaatagttaaacgtataaaaaccctttaatggagctttaattctgctaaaatattttttctgtaaagagtaacagcaggtataatcatgaataccgccaaaaaaataaattggaacttcaagacatggtatttcgacaaaagcattgaactgcatacgatcaaatccgacaggagaagctgccataagctttttgccgcgccagatattgattctttgaagcggggtataaactttgcatctcaggctgggtaaaaaaatgcctgtgataacagatttcatattatgcgtcgttcccacaccaagatcgtgcatggctttatcccgcagggatgacagacaataatcctcatacgcgctatcagaagtagcaatcggatacttttcaaattctttgaccatttttaaattgttcatctgctggtattggtctagcatatattgatacgcaagtctctcggattctgcctgatcagcaatttgggatacagcaatataggcgtgataagattcggggtgctcaaatgctgcttgaatcccaataaaagtaccaaaggaatgccccatcaggtagattttttcttttgaaaaccgacttttcagatattcggttacagcagcgacatcggacaaataacattctgttgtcagggaatccgcattcatattggaatcataggaaattgacgtaccccgatattctaagtaacatacaacaaattcatcagccagctttgatggatacaggtattccaaaaggtattccgggatacctggtcctccgccaaggaaaagtaatacggggtttgtcttgtcccttccggtgataagcagaccgatttctgctccatttatatttatatatattttttctgataggctgtcaggaataatactgccattattattataaaataagggcatttttcctggacttggcggaaggaaattccaaatcaggatagtaatgaatattatgataatccacacagtcatttttcgcctccctttttttactgtattcattatattctctccttaaaactgaactatggttcaactttattgtatgcctttatgcaccctatgtcaataaaatctgaattttagttcactttttcagaagtttatgttattcttgggttgcaatgcttagcgataagacaggagggactcatgggaacagaaagaaagatacagcagcgaacggttgaaaacagaaaaaaacttttatgcgccgcatacagtttgtttgtaaataaaggatattacaacacgaatactaaagaaattgctcgccttgcaggagtatcgattggcaacttttataattattatcaggataagggggaaatttattgtgccttactggaggagtattccattaattcttgcaaagccatgcaggatttaacggaccagcttacagcgcttgagaaccgcaatgcttataaagaatacctttcgtctattttgcatcgattgctggactgtgattcagatagaaataaattttttgtggatgctgtagttatagctaaagaaaatatctgtgtacaatccataatttctgaaacggaagaaaagctgatatcgattttggaatcatttttgaaaaaacgatactataatcggaaggtgaatttctatattagagcaagaatgatatatgtcctgactgatcagcttgctaaagacattctcagcgttgatattggacagcagcgtgaagattatattcaactttttgtggatgaaattatccacctttcctttgaactgtgaatgaggtcggaacagacgtttccatgagcagtttcagactcttcgcatcctgaagtgacagctcgcttcgaagttcctgtgtttcgtttttattaaaaactaaaacagaacatatgtttgcaaatatggttgccggcatctgtcaaggctgttataatgaagagagataagaaacgggaaaggggaggtcatggagtattcagtgattcgaacgccggagcaggttattccatatctgaaaaagctcaaagaagccaaggttctggctgtggatacggaaaccacaggccttgatgcgcataaggaccggcttcggctggtgcagatcggagcagagggaatgccggtattattaattgactgtttttcttttttgaaggattcccggggaacagagtgtctccgggaaatcctggagggagaggcggggaaaatattccataatgccaaatttgatctgcagtttttgagaaaagaaggaattcttccagaaaacatcctggataccatgctggcggcggaattgctgcggccctgcggagggccgcgtaaggtgagccttgcggcggtgtcatcccattatctcgggacagagctggataaaacggagcagacgggtgactggagcggagccttgaccgatacccagctggaatatgcagccctggattcccgtattttgctgcagctttggaaatgtctgaaggaacagctcagagagaacgggctggagaggatcgctgatattgaattcgcctgtgtgccggctctggcacgcacagaatatgacgggatttctctggatttggaacagtgggaaaggctgtgtgcggatatacagagccaatatgaacgctcccttcaggcgctgtatgcttacagcggggaaccttcctaccagctgacgctgtggggaggggaggaagccctggatgtaaactttgacagtaattcctatgttctgaagctgctgaagaaaaacgggatttccgtgtcttccacttcacgttacagtcttgcgccttatcataataaccctttggtaaaggcgctcagtgattaccgcaaatactccaagctgctttccggtttccttcatcccctgcctgcccagatccatccggtgacgggaaggcttcatccgaagtatgggcagattggagcatacagcggaagaatgtgctgctggggcccgaatatacagcagataccaagggaaacacgtttccgcagctgtttcagggctcctgaaggacggattcttgtccttgccgattattcccagatagaactgagggtggcggcccagatttcgggggatgtgagaatgaaaagcgcctattcaaaaggggaggatctgcacagactgacagcttccctgatttccgatacggctccggaaaaagtgagcgcctctcagagacaggcggcaaaagcggtgaatttcggcctgattttcggaatgggtgcggccgggcttcagcaatatgcggcgcagtcctatggtgtagacatgacactggacgaagctgtgaaattcagggacagttttttcagggcttatgcgggaataggctggtggcatcatgatctgaaagccggtcattttacggagggccgtaccctgacggggcgcaaatttttgttttcactacgttccggggtatcggagctggcaaacactccggtacagggtacggcggcagatatcctgaagaaggccctcgggtttttgtatcatgaaataaaggagaaggactggaagctggtggggattgtccatgatgaaatccttctggaggtgccacgcggggacggagaggaagccgccctgtgcctgaaaacggttatggaaagggcgggagcggatatcctgccctcagttccttgtgtggcggatgccaagaccgccgacagctgggcggctaaataatggttacagttcaaccttcagctgatgcctgcccctcactctccatccgttctccttgccggcttgccacatgccccctgtcctcctcccttgccctgtccggctgtccctcccccctgtgcggaagcgccctgcaaggttccctgcagaggacactttcgctcggataaccacgcagcggtactaaggctgcaaaggacgtagcctaaggaccggcgtgcttatgacgcctcttacaggaatccttgcagggcgcttccgcacaggggggagggacagccggacagggcaagggaggaggacagggggcatgtggcaagccggcaaggagaacggatggagagtgaggggcaggcatcagctgaaggttgaactgtgataaataatatactttattctattgcctcaattgtacccacgatatccatttttgctatggaacgcagcggaactgcggtggcaagaagacaggagaggacggaaaccagggcggcctgcagtacaggaacgagaggaaaaggggaaagctgccaggctccgacggctgccgcatttacaaaagaggtgcacagccagccggttattgctccgattccggaggcaatcaggccatagtaagccccttcccagagaaaagtctgatacaggctccggacgctcatcccaattgcccgctgtaccccgatttcctttgtgcgggtatggatgttcgtatatacggtatttatgatattcagcagaccgatcaggccgatgaataaaatcaggccccagcagaggaagttaagctgttggaagctttctgccagctgggcgtccgattgacggtaggacagccaatgggttcccggattggaactacaccattgttccagccatgcttcaaaggtatcgaagtcttctgcattctgcagaaccgggtatacttcggaatagaggtttttcccggtgagggtatcgtaaacggaatcgggaacgaggatttgtacaccgtttatatatccatcgttattgatggtgacgggagaacttatgatgccggcggcatgcaggttctttccattgacggtgagtgcatctccgggctgaaattgtgttgattcggcagtctgcccttcaaaggagaacggtatcgggttgtgtatcagacaggctgtgccgttttttacctcctccgcggcctggtcggagaggccggacaggaatttctccagacggctgtcatcgattcctgcaatctgaaaggtttcccaggactgcagggggaaatcaagcggaaggggaaagcttccgtctttgttccaggtatatatggacagcttagttgtatataattcctttacttcgtcccgttttttcagttccgtcaccgcttccggcaggatcccgcctgtttcattcgtcaccgcgtaatctcccgtatgcatttcctgtaccgcacggcttgtatccagcagcccgctgaagctttgaagggcgacgtatacagtgatgctcattattatggaaagaatggtaatcagggaacgtccctggctgcgtgttatgttcagtctggcataaaaggcttcaaaacagcggatcttaccggacttccggcggggccttcttacctttacagcatcaccggacatagcttctaccggagaaacaagggaagcataccgggcggccggaaaagcggcgatgagggaaaagaggagggtgattccaacgcctgccaggataggaaacagcattcctgtactgctgccggaaatgactgtattcaattcctgcgtgctttcggccaggaacaggctgggattgagaaggccggaagctgcgataaggatcccctttgccgaaaacgaacctgcaagaactcccggcggcagcccgatgacaaagagtatcagcagctggagggttaccagtctataaagctgtccccgttcgcttcccatggcccggagagttccgtattcctgaatcctctttgcgacggaaaccttcagaatattataaatcacaagccctgcggcaagaaggacaaggccccctgtcaaaatgcaagctgcagccataaagggaaagccgtttcctgtatcggagcttcctttttcggcatagtcgataccaagggcgtcaagaagtacccagttgtactggatgttgtccttatccaaagaaagctgagaggccaaatcatcgatgatggactggaagtccccggtactattggttttaaagtcggtggagtacaaaagataacgttccggaagaagggcggctgcgctgccttctccggccagggctgtcatagtgcctgttgtatagccaagataatcattttccaggatgcctgttaacgtgaaggtatgtgtgtattcatagggcggctgatcatctgttttcagactgacggataaagtcagggtgagggtgtcccccggctttttcccggtgccaagatactgcagtacatcctcagaaagggcgatttctccggcgcgggaaggaagccgtccttctttgattctgccgatggagggataggcagccagggcatttccgcggtattcccgtaaaaagagggtaaggctgctgcttccaagccgggtattgccgagctgaagaatgcttcccacatcggtgaggcgggaatcttcagacaggcgcagcatctgctcttcggtcagctgatggaaggtggcatagcggtttccgttcaggccctcagcctgtcgtacccgcatggactgtaatataccaatggatgctcctgcggcagtggcagtgactgtggaaaggataagggcggataaaataagcagcgaagtgattttttccgccttcagctgtttccatgcaagggaaagataagatttcatgattccgcctcctctctgagtttgccgtcaacaatggtaaatcggcgctgggccattcctgccagctgtttgtcgtgagtgatgacgataagggttttgtccagtttcttctgaatctcgcaaagcatttccatcacttcaccgccgcttttgctgtccagatttcctgtgggctcatcagcaaaaatgacctccggatccgcgatcagggctcgcgcgatggccacacgctgctgctggcctccggagagctcgtggggaagatgggacagacggtcctgaagccccagaaatccggcaatctgcatgaggtgtccttcatctgggcgcaccttgtccagcaatagaggcattaagatattttctcttgccgtcagaacgggaagcaggtggaactgttggaatacaaatccgattttccggcggcggaaggcggaaagctctttatccgatccatgatggatatcggttctgtcataggttaccgtcccggcagtgggagaatccagaccgcttatgatgtgcaggagagtgcttttcccgcttcctgacgggcccatgatggagataaaatctcccttgtgtatctccatgcttgcaggcttcagcgctgtcacccggttctcagccgtgccataaacttttgtgatttcatttactgtaatgtccataaaaaaactctccttatcgattgataaagagagtatatatgacaattctcaagaaacgctcaagaattcctgctcttgaaaaccgcggtggcctttgctcctggctgaaggttttccagtgttaagcttccgccatgcttttcgcacaggagcctgcagacggcgagaccgactcccagatgcccgtttccggaggtgtcgtcccggagaaagaaagcaggtcccttttgcaggacagaagcagggtatccggggccgtcatccgtgactgttaggaaaagaaatccgtccctgcaggaaatatccacagttatctgtgaatcagcatagcgcagggcgttacagaaaaggttttctgcggtgttataaaaaaactgccggtcaatttccatttcccgggattctccggattgccttatatccagctgttttccggaatcctcagccagaatgggaaggctttttttcaggatggaatacaattcatagctgccgacaggaaccggacagcagtccagcgcttccatttcccgggtgtggctcatggcattgatatagtcttcaatccttccggtatactgcaggattaagtcaagggaatcctgctgcagcttcggattcggacgtacgggatccaatcccttctgaaggagcaggacggagcccttcagaacggtaaccggattttttaaatcgtgggaaaaagctgcattcagtcttttttgttcctccatttgccgccagagtgtcagcttgctggtttttaattccgaacgcatggcctcgaaggagcggcagagcagccccagctcatccccggaaaccggttccatggcaaaatcaagatcctgcctgcagatccgctcggcgccttcctgcagcagggcaagggaacgtcttattttcaggttatagaatacgatatccgcaaggagcagggataaaacgacccagaaggcgggcaggacgaactgaaggacagtaagaatacgcgcggcgttgcgttcgaaggaagacggatttccttccagagggacagaagagaagctgctgttatcctccagggaaatggcgatgcccccggagccggataacttatgctccaatccggtacacagaaagaaggaaagtccggccatcagaaggccggcacagagaaaaaagcaggttataataaaaaatgactgtttcagattctttttctttacccattccatttatagcctatcccccagacggtttcaatgtaattgtggtcagtatatgccgagagcttggcgcgtattttgcggatgtgttccataacggtgtcgctgcttcctgcgccttccagcccccagacggattcataaatgcgttcccggtcaaatacctgccctgcattcagggacagaagctcaacaatggcgaattccgttcgggagagtacaatagggttttctccgatttgaagctgatgtcctgaatagtcgatggacatttctccgaaaaaacgcaggacattctgtttctttatgcgtgtttccctgcgcaggtgggcggcgactctggctcccagctcctccagatcaaaaggctttacaatatagtcatcggtgccggaggtaaagcctttgattttatcgccggtttccacacgggctgttaaaaacaggatagggcaggagatatgctcccggatacgctgacagacagtaaaaccgtccatatccggcatattgatgtccagaaggataatgtccgggcagcaggcggcctttttcaatgcttcgtttccgccgcaggccgtaagaacctggtaaccggataattcaaaataagccttcatcatggaaacaagtcccttttcatcatccgcaatcaggattttaccgctcatattactgccttccttcccgtttctttttattatgccgtgaagatctcaagatttgctcaaaaaatattttttcttataattggtttttaaagttacggatatgcatgtaaacggtatttttggaaatattcagctgctccgccaccttgataaccgcgtccttcagattgaaaatccccctctggtaaagctggagcactatttccttattcttgttggcggaggaaatggcggagtcactgtaaacggcttcgcgggtttccgtcagggcggaaaaaatcaagtcgtctatattatccgaaaaggtttccgcaggtggctgtgaagcggaaatgttttcctgaggaggaataaagttctgcagaagagtggagagagggctttccatatggaaattcatgcatagcagccctatgatcctgccatgctccccggttatcgggatggtgcaggaacgcaggagagcgccggatttgttcttattaaaataaggagacacggtacgcgccggatccctttccagttctcccagcattttcagggccagatcggtgatgggagagccttctttccgccccgtataatgtccgttgatgatttttataacagaatgatccaggctttccaggctgtggagcacaagctcgtagccctcgcccagatacgcgcccagtccgtccagcatgagggcgtaggagttaagtatctgcctgtctgtagcagtcagttcaatataaggaatatccatataatcaccggtacctttctgaattcaagtgaaataaatttcattatgccttttttatcattataaaatactgtgggtaaatgtgcaataaataagtgaaaaaaattttattgaatatacaatataaataaacaaaagtgtattgactaaaatatattttattgatataatgcaatcatcaagagaaaacaaagaaagaggtggaagaaatgctgaaaaaaatttacacatcaaatgcccctgcggcaattggtccttattcccaggctatcctgttcaatgaacttttgttcagttcaggacaaatcccggtggacccggctacaggggaggttgtccagggagacattaccgttcaggcggaacaggtcatgaagaacgtgggcgcggtactgaaggaagcgggaaccgatttcgcgtccgtaatcaaaacaacctgcttcttaagtgatatgggtgatttcgccgcatttaatgaagtatacgggaaatactttacagagaaaccggcccgttcctgtgttgctgtaaaaacactccctaaaaatgttttgtgtgaagtggaagttattgctgaggttgaaaagtaattggaaggaaatgcgtaattcgcattaagaggggagaatcctctgctcgacagaggtctcgcattttgctacgcaaaacaaggaggatctaaaatgggtgaaaaaaaagtaagagaaaaaaagaaaccaacctttttcctggcggtgctgccgattctggccatgatactgctgttgggtgttggatatgcggttatgggcttaagccctgaggtactgatgcttgtttccgcggccgtggcggccgtgatcgccgttgctctgggatatacctgggatgatatcatgaattccatcgtaggtaagctttccaagacaatgcccgcaatttttattttgattattgtaggttttctgatcggttcctggatgattggcggcaccatccccatgatggtatattacggactgaaaattatcagcccccgctacattgcagtgacctcgttcctggtaacggcagtggtatccctgtgtaccggtacctcctggggttccgcaggaaccatcggtgtggcgctgatgggtgttgcggcaggcatgggcgcgcctcttcctctggtggcaggcgccgtggtttccggtgcgtatttcggtgacaaaatgtctccgctttccgataccacaaacctcgctcccattgcggcgggcgcaaagctgtacgaccatatcggacatatgttttacacaacgattcccggctgtattatctgtctcatcgtttatacgatagccggcttttctctggcaggcggcggaacagttgccactcctgaaaaagtggaaaccatacttgccacccttgatggaatgttcaagttcaatccgctggtaattctgcctcctgttattgtactttacggctccatccgcaagaaacccacgattccggttatgctgatttccagtgtggttgcattcttcaacgctaccatattccagggattttcccttcagcagtgctttacggcagccatcagcggcttcagccttgacatggtaaccaaggcaggctttgatgcggcggctctgattcctgatatcccgaggctgctggaacgcggcggaatgctttccatgctgaataccgttctcatcgcattctgtgcttatggctttgcgggtaccctggcagttaccggttccctggatatcgtgctgaacaagctcatgaaatccgttaagagcacgggcggcctgattgtatccacaatcgtttcctgtattaccgcagttttcgtaaccagcaacggacagctttccattctggttcccggcgaaatgttcgcaaagacatatatcaagaagggactgcagcccaaaaatctttccagaacgctggaagactccgctaccgtagtggaacccatcgtgccctggaccgcggcaggcgtttacatggctaccacactgggcgtgcctaccctgacctacctgccttgggccatcctttgctatacaggtgtgattttcgccattatctggggctttaccggattcggaatcgccaagattaaacccggcgatgaatattacgatgaataccttgcccttcagaaggaagacgaggctgcataagaaccattccaggaggaggtttttctatgggaatgcaatatgattttgataccatgacggaccgcagaaatacaaactgcggcaaatgggataccatggaccaaaaatacggccggaaggacatgatccacctcggcgtggctgacatggatttcaaggcgccggatccgattttagacggacttcgtgatgtcctggacatgggagttttaggctataccgatttaagtgataaattttttgaaagcatacagcgctggtacaggaagcagtacgggctggagataccgagagaatggatcgtattctgccccagaatcaatatcgcttccagcatctgcgtggacacctatacggaaaaaggggacggggttatcatgaatacccctgcctacggaccgctccagagcgccattatcaaaaatgacagaaggatgctttcaagcccgctgtcaagaaatgcagacagatatgaactggactttgaccatatggagagcctggtggatgagaggactaaaatgctgattatgtgcaatcctcataatcctaccggacgctcctggacaaaagaagaactgatccggacggctgaattctgtaaaaagaatgatctgattctgttttccgatgaaatccacggagacctgacggcaggaggagtgaagcataataccttcctttccgtgacagaaaacataaatgaaaggctgattctggcaacctcgccggccaaaaccttcaatatacccggcgtcatcgtttcctatatgatcattcccaaccgggagctgagagagcagatagcagccaccatagatcgtatcggcatgcataaccctaccatctttgcggttacggccgtagagaaagcctatacggaatgcgatgaatggtatgaggcggtaaaaaaatatattgatgaaaatgaaaaattcacaagagattattttgccggacatttcgaagcgtttcatatcctgccaagggaaggtacctatctgctgtggatagattataccagaaccggcatgagtgaagaagaactggagcagtggttccttaaggaagccaacgtatccgtgtatatgggaagcatattcggtgaagcgggccgaggttacatccgtctgaatctggcatctcccagaagccttctgaaagaagcatatgaaagaatgagaacagcctggaggttctgaatttcataaaatacgcaagcccctgccgcagcggaaaaacattgcggcaggggcttgcggcgttttacggcagctgtaagctgtaaaaagttccttttttccttctgaaaaacaggccggggcttaaccgggctgcttcatggattcaggagcgggcgggaagagaatacgcagtttgaaaaagcctttttccagctgataatccacggctgcattatttttgtgggcataagccaggatgctgcgggttccgatgccatgcccgggactgcctgatatcggaatatggttctcatcaaaaagaacagtcttttcctcacaggtgtttgtgatggcgaacagcagctggtattcctccaggcaggtcagccttatttcccgtttcctggcctccggtacttttaaacaaccatttatggcgttttcaaaagcgttggccatcatgatggaaaattcggtttcatcggaaagatttttacagtctgccttaaaattaatatttacacggatgccaagttcctctgccctggaagcataataagaaagggtggaattcatggtgggatttttgcagtaacaagtcaccgcagaaatgctgcacagctcctcaaaatgctgcagatagctttgggcggcctgaagattgccgtcattaagacagaccgaaagctgattcatatagtgacgcagatcatgacgcaggattttttttttttcttctgcttcctggaatatctgaagctgatgacggaacccggtaagctgggattggaggatagcttcattctgcagcctggtatccagactgcactgataatacagcagggcgaaaatggttaaatatacggtaggaatgatgagcagaagcagtataaaggaaggcagctcctgagggcgttccgttattcttgtgggccatcccgacattagggcaaaaaaagatagaacagacctgatgcgaaggcaaagccgccccagcccttttttacgaactgtagaatcagatgatagggcttctttacataacgcactacgaaatattccagtaaaagaaacatgaatatgcgcagaaggaacatcagcaggaagttttccccgaaggcataagaaatcagattggaaactgccatgatccagaagcccataatatctgcaagacagaacgtgaaaaagaaacgcccgttccgatcctttgacgtataaaagaaataaaaaaagcttggtattgtacaggtaagaataaaatattttcccatccagatgacacccatcttcaggacaagaaccatattcagtataatgagcccgcccatacaaatcaggttaaggaagaatgttttctttcctggaaacctggattcgtaaagctggctgaagataaacagaatattaattaaacaccacagaatggataaatctctataaatcatcgtatttaccctcatatcccttattaagcataaagtcgatgtacagctttttgatggctgcataattattccttgatataggaataagcgtggaatttttcagggtaaagtccctgccctgaagacagataacataattcatgttaagcagaaatgccttgtgcggttttataaaaaaaggaagctttgtaagaggctttacaatttcatcaaagttatttctcatggtaatgctgttatatatgctttcatcctccatattcaccacaatcatatgattcaggtattccacatacataattttggagcattccagcctcatgattccggtttttgtttttaaaaggaagaagctcgtgtcggtatccttcagatgcagaagagcttctgagaggatagggaagagattggcctttgtgatgggcttcacgatatactggaaggcgaagacatgaaaggcatccatggcaaagtccggcgaggaggaaagatagataaccagtgaagaaggattataattatgtatttcacgccccagatcaataccattacggtccggcataaggatatcaagcagatataaatggtaaggaggctcactggacatggaggccagcagctgggccgcggaagaaaatacctttacctggaaggcggcagccgcattctcctccatgaaggactgcagcagggattttgtgtcttgggcatcgttcctgttatcgtcacatattgcaattcgaatcatattttcagcctgtctcctctagttttttgattctgtcatggcagtgtcaatgtagtcatccacactggcaatataaatacctgcagatatacaggtgagaattccatttacggtatagcagatgccgcatacaaaatccatgaatctctgcgttgtttctgcatcaagataattcaggttcaggattaccgtttcaccaagcagcagcttcttccctacggatacaatctgcgataactgggtgggaacaataaccataatttcccgatttactatttgtttcatctgaagttccaattccttttttccaagatattcctggaaatctactattttgcagcaactttcctgagaggtcatatcattcatccttcctgcgtacctatcctgattcaaggaaacggaatataaaaaagattataccgtaattatgtttgattgtaaaatgagtataaaatatacttgattctataaaattttgttatatttgtatttaattataggtaatttctgacataaaatcaataatttcacttataaaacaggattttgcactttaattgcagcaaagtacggtgcggtatgaacaataagcttcaagaatgtttatcagcaaataactactgtaaaatatttacattacctctggcaattgatataataaaaaacaccggcagccggaactttgtgtaagctcctgcctgtcataaacagctgtcccaatcggtaaatcttttttatcagcatttcaattttctgtccgaatcggacaattactcaacatatatctaaagagataaaattctgtgtaataatgaaatatggtcaatattaacagatcagcatgtaagatacggttgcccggtgtcggattatcagttataattatatgaaagacaggattttacacatggcttacggaacaggaggctgtgtgaaaaaacgcacgaaaaaggtaagtaaaggacaaacggagaagaaaactccaggtaagaattccattcaccatgaagatttggctctgaaaacagccgctcagtatttcggtgaagaactgatgccgcttctcggcattaagggggtggccggctatattgcgcctaccgagacagtaatacttgaagcgcggcaaatgtaccaagattttaattatgtgatgacggatgccgcctggatacatctggaattcgaaagcgatgctgttaccaaagaagatctggaacggttccgggaatacgaggcagctgtcagccgggcaaatcatgttgaagtaatcacctatgtgatctgttcggcgaaaatcaggcatccccgatcggtattaagaacaggaattaatctttatcgggtgaagactgttcagttaaagggtaagaacgcagaccggctgttcagacgactgaaagaaaaagcggaacagggagaggaactgacaaaggcggatctggttcctctcctgctgacacctcttatgtcaggcagtctgaggattgaagaacggattataaaaagcctgagaataatccaaaaagccggagaagtcctgactgaattggaattgaataaaacgcaggctgttttgtatactctggcggataaatttttaacggaaacggagttgggcagagtaaaggagatgatagcgatgactaaattaggagaaatgctggtagaggatggaatcagaaaaggaatggaacggggaatcgaaaagggaattgtcgaaacttgcagagaattaggtgtcagctttgaagatactacggaaaaaataaaacaacggttctgtatcagtgaaacagacgccagggaaattgtgaagaaatattggctttaaccaaacaaggatatatgtttcctggaatctgataaggagaaggcgataaaaaccttctcctttcccaactgctgattctcattgatgcataacaaatccatatagcagcatgaaaataaaaaagtcttctgccggacggttgacaaaaggaatgccggctcatataatgaaacataatttcataggaaaaagcatggaagggaagagtaggctgccggcgcttttacagagaatctgtggtggtgagaacggatgaaggaaaggctgctgaacatggtcccggagctgcgcaccgaaaacctgctggttcaggctgcgacggattcacccgttaacgtgatagactatcgatgaatcatttctcgtccgtagttgataaggcctgtgccgtgaggaacaggcgaatttggggtggtaacacgaagcgatgctctcgtccccgaaaaagaaatttttcggagaggagggattttttttgccttaacagcggattcggcgttccgcgttatcactataaattaagaaatgaggaaacaaaattgagagatatattaattggcggagcctggccctatgctaacggctccctgcatatagggcatatcgcagccctgcttcctgcggatgttcttgcacgttaccacagggcggccggagataaggtctgttatgtttcaggaagtgactgtcacgggacaccggtagcaatccgggccagacaggaagggaaaacaccggaggagatcagcagccgttatcacagggaatttgcggaatgcttcagaaagcttggattcagctatgactattacggccggacctcatcggaagagcataaagaatttgtgaaggaattccacaaaaagctgtatgaaagtccttttgtttatgaaaaagaagtcccgcaggcctattgcgaaaactgcggttccttccttgcggatcggtttgtaacaggaacctgcccggaatgcggcggtgaagcgaggggcgatcaatgtgatgcatgcggtacggtactcgaagcggaaagtctggaaaatcctgtttgcgccgtatgtggttccgaaatttccttccggagcagcaggcatctgttcattgccctgggccgtatggaacaggaactgaaaaattgggtggaaagccatgaaaactggaggaaaaatgcgcagaccttttccgaaagatatataaaggaagggctgagagacagggcgctgacaagagatttggactggggaatcgaagtgccgcatgcaggctatgagaataagaaaatatatatatgggcagaaaatgtcctgggatatctgtcttccagcagagccgccctgaaagataatccggaagcgttcaggcagctgtggggattggacggggaaaaacagtgtgaagatgaaaaaacggaaatccggcattattatgtgcacggaaaagataatattccctttcatacgattatcctgcccgcgcttttgattgcgaacggagacggctggcgcctgccggatgaaattatttccagtgaatatctgactctggaaggaaagaagatatctacaagccggaattatgccgtatgggtaaaagatatcgtggacagatatgacggggattccctgagatattatctgctggcaaacgggccggaaaagaaggatgctgatttttcctggagagaatttgtcaacagccataatggtgagctgctgggcgcatatgggaattttatcaaccgttctctggtatttatccaaaaatatctgggcggtacggtgccggaaggaataccaaatcaggagcttagggcggaaactaacaggctgtatgcttctgtgggagagcagattgaaaaagggaggtttaaggatgcactggatgatatattcgagtttgtacggaaagcgaataaatattttgattccagacagccctggatcacccgggatacggatcagaaggactgtgcggataccctgtataattgtgtccagctgatcgccggactggcagtgctgctgtatccctttcttcctttttcttccgaaagggtatgcggctggctgcagctgtcaccggaatggaaaaggcagcaggtggaaccgggataccggcttcccgaaatacaggtgctgtttcagaggctggataaaaagctggtggaggaagaaaatgaaagtctggaaagagcctgtccgggctgaggcagatgtggcaggatgactgtcggcaataaaatatcagatctcgttgtgataccatataatacggaataactaaggcagatctgaaaaaaagaatattttatcttaagaaaaggacaactaccaaaaattagaaaatggaggtgtcctttttttgcgattaatcttaataaatggaaattttatgatatctatgccggtagataagtaccatttttttcgctatacttgatacagacgtcaagaaagcgcatgcatgggctgaaatcagataatggaggaatttgtaatgaagagaaaaaggattttggcaatcgcattaactgtagcattagttgcaggaagtctgagtggctgcggcagcagtacaaaggaaacggtatccggtgctgagaaacctggtgaaagcaaggaacaaataacacttacctttttacgggcaggtacttctgaaaacgtacagaaggtatatgaagaattaatttctgcttatgaagcagagcatccgaatataaaaattgaatatgaacaggtgggattcggcaatgaactggaaaccaaactgaataccttatatgccagcggtatggcaccggatattgtgcgtgctcccatcagtacgattgctgaaagggcatccagaggacaatatgccaacctggatgcttatattgacagctgggaagaaaaagatgatataatgcctacggcttttgaagtagccagttataatggaaataaatacggtatcgctatcggaatcgaagccagttttctgctttacagaaaagatatgtttcgggaagccgggctggatccccagaatccgcccaaaaactgggatgaattactggaatatgcagaaaagctgacagtacgtgatggggatgcggttacaagagcgggcttttccatacctacatctgccggtcacagtacatttattccatttgcaagacagaatggagcccagcttgtggatgtggagaaggatgtacctactttcaatgatgcaaaatcagcagaagcattggattatttgagccagttcagccaagagaatctactgatcccttttatcaataacaaagatgacaatccttttgacagcggtaaggctgccatgacatatggaaatataaattcttttatcacccttcaggcaaaggaagtggactggctggatgaactgggatttgcgcccggaatagaaaaggaaaaaataagctccttcggtggctgtcagataatgtttatgagcgaagaaggcaagcataaggaagaaacctgggaatttatgaaatatctttttgaaaatgaaaatgtatggaagctaacaacggaagccggcgcggcacccgtaaagctgtcactgaaggataaatatctggaggaatatccggaaatcggagcagcttatctggaggcgttggaatatgcagaaggtatgccgaaggtaacatgggcggcactttttgaagaggcggtctgcacggcttatgaagaagccatgtatggaaagaaggatggccagcaggctcttgatgatgcttataattggctgatgaaggaaatgggaaaataggaggaaatccgaatgctccgacgaaaaaagaaaatcgggaacgaagcggcaggctatttatttattgccccatattatctgttttttatttatatgcttctccttcctatccttaatacggtaataaacagttttaccaattatgatttatatgaaaaaagagattttgtagggctgcgtaattatgtggatttgattcatgactccctgtttatacaggcactgggaaataccttattttattcagtactttatattattcccagtatggggctcggtcttctgctggccctgcttcttagcaatgaaggaaaaggctttaaattctttcgcgctgctttttatataccttatgtaatttccatggtttgtgcctctacaatctggatgtggatttttgatcccgccaacggaatattaaaccagatactgaaggtattcggccggcccggaggaacatggctgaaagatcctgatatagccatgtattgcgtggtatttgtaagtgtatggaagtctcttggttactgtatgctgattaatctgtccggtattaaaggaattcccggatatttgtatgaagcagcccagcttgatggtgcaaacagatttcaaagatttattcatatcaccctgccgcagctttccccaactacctttttcctgttcattacttcatgtatttcatcctttaatgtatttgaacaagtaaatgtgctaacggcaggcggaccgctaaataaaaccactacgattgtccatcagatctatacaagaggctttacacagtttaaaatgggatatgcgtcggcgatgtctgtggtattgctgcttattgtcagtatcataactcttgtaaattttaaatacggcaatcagggaaaagatattgatataggataaggagaagataatggcacagaaaaaaacgacccggatttgtatttttgtattctgtgtggtgctcagcatcattacgctgcttcctttgcttttgatgctgcttacctctgtaaaaagtatttcggagatcaatgccgaacaatttgtattttttccgaaacatattcttttttccaattatgcggaggcgatgaaaaagggtgactggacggtgtatttcaagaatacgattatcgttaccgcaattacggtgggaatcagccttgtgatcaattcccttgcaggctatgcctttgcacgaataccttttaaaggaagggatttcctgttttttctggcaatggtcggtatgatgataccaagccaggtaactatgattcccgtatttatccagctgaaggaattcccgctggcaggagggaacaatattctgggacagggaggaaccggtttgattaatacctatgccggtttaatactgccctatatagcgggggccttcggtgtgtttctctgcaggcagttctacatgaatattccccaggcgcttgacgaggcggcaaagatagacgggtgttcaaggattatggcatatgcccatatttttctgccgctgagtaaaccggtactggcaacgctggcagtactgaagtcttcacagacatggaatgattacttatggcccttaatcatgataagcaataacagcagaaagacggtacaggtggctcttgtaagcacttttgtgaccgaagtttccacaaactggaacctgcttatggccggtacggcaattgttatgctgccgctggtaatattatttctttttactcagaaatattttgtggaaggagtggtttcaagtggaattaaaggataaatgtcccaatattattctgataaattgtgatgatttgggatacggggatgtcggttgttatggttccggcgttaaccggactcccggaattgattacctggcacaaaatgggatgcgatgtacctctttttatatggcgtctcctgtatgttcaccctcaagaggggcaatgatgacaggctgctatccgcccaggattggatttgaatcctttgagggagaatgggtattatttccaggacagggggtaggcctgaattcggatgaggtgaccattgcgcaaatccttcagcgggccggctaccggacaaagctggttggaaaatggcattgcggcgatcaggaggaattccttcctaccaatcatggatttgacgaatattatggacttccctacagcaatgatatgggaagacaggtatttaaagaagattttccgccgctgccgttgctgtcaggtactggtatagtggaactgcagccggatcagagatcgataacggagagatatgtggaacaatgcaggacttttatccgggaaaataaaaataataaattcttcctttatctggcccatatgcatgttcacctgccattatatgcaggagaggagtttgtaaagaagtcaattaacggcgatttcggcgcatgtgtggaagcaattgactggtcggtacgtgtccttttgcatgaactgcgttcgctgggactggaagaggacacgctggttattttcacttcagataatggaggacgaggagatcatggcggaagcaatgcgcctcttaaggggaataaaggcactacttgggaaggcgggcaaagggttccctgtattttttattggccggggcatattgctcccgggcaggaatgccgtgagctcatatgctcccttgatttttaccgcacacttgcagaacttggccatggtacaatgccggcggacaggaaaaatgacagcctggatatccgcagagtgatcctggaaggaggtaaaactcccagagataccttcttttattatataatgggaaatctggaagccgtcagagataaagaatggaagcttcatgtcgcgaaagatggaaaaccggtacggcttctgtatcatatatcggaggatccgggagaacaggaaaatgtctatgaaagccatccggagattgtaaaacatctggaacattcacttgaggaatgccggtataaattgggagacactttagcaggtataaaagggacacagatcagaccgataggcagagtagagaatcctcatccattggcggaatatgatataaatcatccttatgttgttatgatgtatgatcgggaagaagtaggatagagaagtaagagaaagagggggaaaaggatgaaagaacggagtaaagtccgtgcatggcgcacaattaaaggtaaaatgcggatatcttattctgttattatgataattatgtgcggtgtcctttttctttcctatttcgcttcccgttctactattgaaaaaaatgcggtggaaagcagtatggcggcactgaaggtggtggctgaaaaaacggacagccagatatcctatattattaatctcagtgatttgatatataatagttcaacagtgaataatataatccgtgatatggaagacagcagtgatttgtatgcctggcattacaattatgttcagctttaccggtttatgcaggactattacgattctctgtctatgaacaataaggattgtcagattatattatggaatcgtgagcaggaaatcctttattattcatgggcatatgatgaacccagtaaagaggaaatcaggaacgacctgaaagggttggagggaaaaggaaccagacgttattccggattaaggagcagttacggtaatgctgggaaaggaaaatacttctacttttataatatgtattccggtgtccagaaagaggaagaagagttgtatgtcattataggtatccgtgagcaggatttgcagaaaatgatgcgtgccctgactgataatggcagcggtataatgcttatggatgataaggggaaaaagctatatcagaccggagagatttcctggatgcaggaaagagagacagagcaggaagagagattccatgaggaggcaggcacctttattactcatactttacatgaaagctggctgaacctttatactacattggatgcggtggactggaaactggtacagactattggaatgaaggatgtcttaaaaggttttaatacctggtggaaaatcagcattttgtgtattctgattgttgccgctgcagtttttgtggtcctgtatcttctggataagagtatttttcaaccagtgaattatctataccatgatatggaaaggctgaaagagggaaaaaaagagcttattctgcctgataaaataggagaggatgaaataggaaacctgaccagacaattttatgaaatggtaacacaaatagaagtgctggaagaacagcggatccgtaatgaaaagcagaagagaaaactggagatagaggcacttcaggcccaaattaatcctcatttcctatataatacgataaacgcggtaaaaatgctccttcggatgggaagaggtgaagaagctacagcggcattgactgcgttagtggatattctgaagaatacactgtctaattcggatagttatgtgactcttggccaggaagttaaacttctgcaaagctacatatttatccagcaccttcgctatgatgtttttgaatttcatatggatattccggaagaactcaatgaatgcaggatacttaaattcatgattcagccatttattgaaaattcttttctgcatggatttgaggaaattacgcgtgatacaatgataacggtttgtgccagggagcaggaagggcatttggaaatctgtatttcggataatggaagcggtatggaggaagcagctatacagcaaatccgtaacagcagaaaaaaagaacgtggaataaacggtatcggcattggaaatgtcattgaacggattcaaaggaactatggagaagattattatgttgatatacgcagcagaaggggaaccggtacacatataacgttggttttgccgctgctgaggagtgtggagaatgaagatcctgattgtggatgatgaacagattatgcgtaatggactcagagtgacagtggactgggaaagctacggttttgaaattattgatgcagtggctaatgggaagagggctatccaggtatgcgaagaaaaggctgttccggatattgtgataaccgatattcgtatgcctgtaatggatgggctggaacttacaaaagaattgacgacccgatatcctcatacaaagattataatcatttccgcttatgatgattttaaatatgcccagcaggcaataggattaggtgccagtgaatacatattgaaagcagatctggactgtgatgcacttctggctgtactgattaaaatgaaggaacagatagaacagcagcgctcagcggagaaagaaaagcagaaagtaaacggactcatggaacagctccaggataatcttttacttcgtctgctgtctactccctgctatgaaggagacgtacaaagaaaaatacgcgaactggatatggaactgctgccggaaaacctgtatatgattcagttttggtctgacatcagagacagagaagagataaaggtaatactggaaagaagcggtcttcatcatggatattggctggcctccagtaaaaatcattatatacttattgctaatggagatgaaaaacaggaaaaagggaggattcctgcaggacttgaacagatcagggagctttgcgggggaaatatatactgtagtggcccttttgatgggtttggacaaatttatatgaaaaataaagacatgaggcctgttatggaatttaataatttttatgacaggaaaggtgtgttttattataaagatgggatgccggaggctggggagctgaattactctaaaagcctctcagaattccttttgcttctggaaggaaactatctgaaagaggcaagacagctgataatagaaatcctgatggattttgcaaataagatgtacaatccggaggatatttatgaattaaccggtattttatgcgatatggcacgggaaaaagcaaaggaaatttacaggctttcctgttgtgcagaggagattccccactgggagggaagcgatgggatgatgataaagcagagaatccgcagatataagaagcttgttgaattgacagaagcttccgaaggatatttccgcagtctttttgattatatggaaaaatacttgtatcattatgataagatagtcagccaggctgtccggtatatgaacggacatctggaagaagatatatcccttaaggctgtagcagatgtgatctattgcagcgcgccatatttatcgtcactttttaagaaggagacaggggttaatttctctgagtatctggtgaatatgagaataagaagagcgcagaatctgctgctttccacaaaactgccggtgtccgagatagctcaaaaggtgggaattgcaaattgcagctattttataagggtatttgcccggatcacgggagtaacaccggtaaaatatcgaaacagagagcaataaaaacggggattttcatccccgtttttattaataattccattctttacaaggaacgcctgtcgaatttctcttcgcagtacttacaccgataaatctctttcttttcatcagaaagaacaaagatatgaggcagtccctgttcaatagatgttatacagcggggatttttacaatggatgacatttttgatttctttaggaagaatgagttctttcttttcaacaatttccccgttcttaataatattaacagtgatattgtgatcgatgaatgccagtacatccagatccatcatatccacatcacattccaccttcaggatatccttctttcccattttattgcttctggcgttttttatgattgccactgtgcaatccagcttgtccagctgcagatggcggtatatggacaggcttgttcccgcctttatatggtctagtacgaacccttcttcgatttttcctacatttaacatatatatacctttccgcccggtaagagggcttttagcaaataaagataccgcattatgagtcaaccgtaattcccagaagcgtaagtatcaaagccatgcgcacataaaccccatactgagcctgcttaaagtatacagctcttgggtcatcatccacatcaacggaaatttcatttaccctgggaaggggatggagtaccagcatatccttgggagcgagattcagtttggctttatccagaatgtagtagtctttcagacgtacataatcctcttcattgaagaaacgctccttttgtactctggtcatgtaaaggatatccagccggggcatgatttcttcaagctgcataacctcttcataggggatgtccttatctttcagcatttcagtgatataatcaggaacccggagctcatcaggagagatgaagatgaagcgtacattatcataacggacaagggcgttgatcagggagtgcacggtacggccgaacttaagatcaccgcaaagaccgatggtaagacgatccagacgtcccttcagggtacggatagtcattaaatccgtcagtgtctgggtaggatgctgatgaccgccgtcaccggcgttgataaccggaataccggatacggatgcggctaccataggagctccttccttgggatgacgcatggcacagatatccgcatagcaggaaatgatccggatggtatcggctacgctttctcctttggaggcggaggaactggcggcgtcggaaaagcccagtacactgcctccgagattcagcatggcggcctcaaagctgagcctggtccgggtgctgggttcgtaaaagcaggtggccagctttttaccttcacaggcatgggcatatttgggcatgttgccttcgatatccctggctgtctcaaaaagcctgtccagttcctctacggaaaagtccaggggattcattaaatgtctcatgataattgggtctcctttctgtgaaaacgtggagaaaagggatacttttgggcaaacaataacgcccgggttgacaggcgttaattttagaaaatcgaagagaaaataaataattttcccttcgacctatattctgatgtaccatatggatttaaaaatatagcgttgccgcaatgcttactaaacaatcccataatttctccaatttttacagctgcttactgtttgtgacattatagcacattgaaaatatggtttcaatttttttttgaaatttgtattaaaaacgctagaatgccaaagtaaattccagttcatatatcctaccagatttaagtttgacactccttcctttacaatggacattgcagtatgtctgttggaaaggagtttttatgtccaaatcaattcatacacaaaaacatatgactctctctgatagaatctacatcgaacaggctctgtctaatcatggttccttcaaagatatagctgccgttttgaaaaaggatccttccactatctctaaagagattcgaaaacatagaaggcctaaagacggcagtcattatcatctgaaaaataattgtgctctgctttcctcctgcaattgcagccgtatatgtgatggcaaactttgtaattatctttgcaagcgcagcaaatcctgtgactgcacaaagcattgcccggatttcttcccttatctttgtccgaaactcaaaaagcctccctatgtctgcaatggctgctccaatcatgcctgccgacacgataagtttttctatcgggccaaagatgcgtatacttcttatgaacagaccaagcatgaatgcagacagggaattaatcttaccccggaagaaagagctgccttagacgagcttgtggcacctctcattctcaacggacaaaccatggatcatatttttacggaacacaaagaagaaatcccctgctcggaacgcactctttatcgttacattgattccggtattctttccgtaagaaacattgatcttccaagaaaagtaaaatataaaccgcgcaggcagtctgacacttccgaaaagttaacgagagaatgtaccatcggcagaacctacaccgattttcttgaatatctcgaacagtatcctgaaacaaacgtggttgaaatggatacggtagttggtccggagccgggtaaagttattcttaccatgctttttagaaactgtacctttatgctagcttttctcatggataatacaaaaagcgagtctgtcattaacgtatttcattttcttcaaagggaattagggacggaagtgttttcccgcctctttcctgtaattcttactgacagaggttctgaattttctaatccatgggctatggaatgcgatgaatatggggaaattctttcaaaggtattttactgcaatgcaaatgcaccttatcaaaaaggaagattagaaaagaatcatgagttcttacgctatatcatgccaaaaggaacttcttttgacgctatgacgcagaaatatataacccttgctgtgaatcacatcaattccacggcaagaggcagtttaaatggcaggacgccatttgaacttgcctccatgctgcttgacgagaagctgttcaaacttcttcgtttggaaccggtagaacctgacaaggttctactcaaacccgcactgcttaaacagcgctaaccatttttgaaacagacatactgcacgacaacggcatactctttcagtcagacaaccggaattcagtttgacagacacccttccggttgtctgttttccatgcagaaaaacagactgtttccctaactatcatacatctttctatcaaaaatgccaaagaaaaagttggctcaaccccgcattttctttggcattctagaatttcatttgtcactggaatttactttggcattcaaccttgtattaaaaaccccgccatttttgataaaaagtccgcactttctgactggcacggagatattgaggacgctaagataattacagataccgccatcccggcgctccgcccgggatggtgaataagcagttaaaaagtccatgaaaagcagagaggggaacagacaatgaaaaacacaaagacattcaagaatccgattctatccggcttttatccggatccgtccatttgccgcgttggagaagactactatatggtgacctcctcctttgtatatttcccggggctgccggtatttcacagcagagatctggtacattgggaacagatagggcatgtaattcaccgtccggagcagctggattacaaaaactgtgaaacatctctgggactctgggctcctgcgatacgatatcatgaagggacattttatgttatcaatacctttgtttccgagggccgtgaggcgcgcagagataattatatcgtaactgcgaaggagccggcagggccatggagcgatccaatatttatagaaggtgcggacgggattgattccagcctgttttttgatgatgacgggaggatatggtacgcagggaatttcatttgtgaggagcctctttacgaaggccatcacggaatctacttaaatgaactggaaccggaaacctttcagtttaaagggaaacgaagtattatctgggacggcagcaagacaagaagcaagtggattgaagcgccccatatttataagaaagacggctggtattatctgcttgttgcggaaggcggtacttttaccaatcacagtgtaatgatggcaagatgcaggaatattgacggcgattatgagatctgtccccgcaatcccattgtttcccatcgtcatgtatccttaatgagtgaaatcgctgtggtaggccatgcggatatcgtgcagacgcaaaagggagagtggtggatggtactgttaggaatccgcccctatgaaggctttcattttaatctggggagagagaccttcctcgttcccttccactgggaggaagacggctggccgcttctggattcagagaatggactggtaaacagtacggaaagagtgcctgatctcgaagaagtaatctatccgctgccgatcccctgtgataattttgagtcttccgctttaggccttatgtggaataccatccatccctgtaaggagcccttcttttctttagaggccagaaaaggctttttaaggctgttcctgaaaaaagaggtacttcacagtatctgtacgcctgcatttataggcagaagacagcagcataaagtgtttcaggcactgacagcaatggaatttgagccctgtgatacccttcagggggagggtgaagaggcgggaattgcggcggtgcaggatgacagattccattatgcccttgtaaaaacccgtataaacaattccaatttactgcggttataccagacagaatccggaatccgtacactgcttgatgaaaaagagcttgaagaggatggaagaatatatctgtccattcaaggcagtgaaacagactaccgtttttactatggttttcaggaaacagagaggcgccccataggaaagccggtaaaaggaagtcttctttcctccaatacaaacgaaggatttaccggtacatatattggaatgtatgccagctccaacggaactgagaccactaattatgcagattacgactggtttttatatcacggagaggactgaattccatacctgaaaggaaagcgctcatgtgtcccatttctgccggacaggcggcgacaggcatgcagagacaggacaggcatgcggctgccctattgacagtggtaaacgaaatgcctataatgtagacatcaaacaggagagggtgaacacaatgttattcggaaggttttgtattgatctcggctctgcacaagcatgtaagacagaacattgtgtggagcccaatcagataaacaggattatttgagcggcagggctattcagatcagaagtttctgatttaagagcctttgttgtattgcccttcgaatgaattcaaagattggatatgcggccatagacaatgttttgtctatggccttttgctgtctattcatcacaagtattatcagaattgtgtatggaaaagcagaggcctcccctgtgggtgtgtgagcctctgctttcttattttgaaaggaaaaataaaaatggaaaataaagaacagaatttaacggtgggaagtgttccccaaaagctgatacgttttgcgcttcccttatttggagcaaacctgcttcagtcattatatagcattatcgatatgctggtagtggggcgtattgtaggaaaaaacggtcttgccgctatcagtaatgcctccatgatcggctttatcatcaattcgatttgtataggcgtgacaatgggaggaacggttctggcagctcaatataagggagcggatgatgaacaggggcagaaagagacgataggtactttattcagcctgtcctttcttgcagcaatccttgttacggctgccgggctgcttctgtacgcccctcttttttcactccttcatgtgcctgtggaggcgatgaaagatgcctgcagctacatggaaatcatctgtatgggaaccatatttgtttttggctataacgccgtttgttcactgatgaaaggtctcggggattccaaaagcccgctcttttttgtggcggcagcagcgcttgtcaatattgttttggatttgcttttggtcgggcctctgggtatgggaacaaagggggcggcttatgcaactattttttcgcagggtgtctccctcattatttctgtggtgcatttaaagcggaagaggtttctatttgattttaagctgaaaagctttgtcatacgtaaagataagctgctcatcattttaaaagttggtttgccgaccgctgttcaaatggcagttgtgaatatttcttatctgattatcaccggtatgctgaatacctttggcgtttcggtggcggcggcctccggtattgggctgaaaataaatacctttgcggggatgccgtgctgggctgtcgggcaggccgtaaccactatggtggggcagaatatgggcgctcaaaatatagaaagagtgaaaaagacaacacagatcggactgctgattaatgtttgtgttaccgtttttgcagttgtattggtacagattttttcggaaaaccttatcctgctttttgatccggccgggacagaggttatcagagaaggggtcatgtatctccgtatctgctgcagcgttaacagcctggtatatgcggtcatgtacacgttcgattcctttgcgattggggcaggagctgcgaatgtcgccatgtgcaatgctcttttggatgcggtggtggtgcggctgcctgtctgctggcttctggcattcccccttcaaataggattcacaggaatttacataggccaggcaatttctccggttttgcctgctattgcagggctcgtctattttgcaggtgaaaaatggtactcaaataaattaatcagtaatgatatatgaatgtaactggtatagaaaggaatgctttggagcaatgttaaaggaaagatcttgacgcgctattgtcaaatttaaaaggctgggatattattttattaaatggaggcagttaacatgaaaatgcggaatagttatacctgtccgttggaattgacgcatgatatcattcgcgggaaatggaagcccattattctgtggcagttgggaaaaggggcggcgtccccgtcggcccttcagaatgatatcgtcggaatcggacagaaaatgctgctgcagcagcttggagagctgcagaatttcggaatggtgcagaaagaacagtatgagggctatccccttaaagtgaaatattcactcacagagaaaggggaacgaatgttaaacatcattgctgccatgcaggaaattggaattgaactgatgaaggatgatggcagggaggaattcctgaaaaacaagggattgatataggtgcacacaaaaaagtgtgtaatgtacaaacaaatcccctcctgttagaataaaaacaaaaacaggaggtttttatcatgatgaaaaatccggagcagacgataggaaatatggcggataaatgcagcacggtttttatgagttataatgatgatgagggtttcccggtcacaaaggcgatgctgaagccgagggtacgggaaggaatccaggtgttttggtttcatacaaatacctcgtcaaacaaagtgaaattttacagggaaaatccaaaagccagcatttattttgtagatacccgtttcttccgcggggtatgtctggcgggaaatgtagaagtgctggaaacaagcgaagctaaggaaatgctgtggcaggaaggcgacaccatgtattacaaggaaggcgtaacagatcctgattattgtgtcttgaaattcacggctgtcaaaggaagatattacagtaattttcattcggaggattttgtaatttaaatctttgttattccatatccatttcatatagcctccatattggtatggtatcctgtccatacaataaatatggaggtgttctttatgggttttctcaaacgggcgtttttatacgtcaccaaaaaaagagggaaaagtatcctgctgttcatcattttcctggtaatggcaacatttgtgctgacggggctttccattgagaaggcggcacagattgcgcaggataatttgcgttacgcattgggaggtgaattcgaaatagtacccgactactcggaaagcaatccatactataaacgattgacagatgatgagggcaatttttcaatttatactgaacgtcccgtaacgcaggaaataatagataaggtgatggaaacggatgggattaagagctatgacggtatggcgcaaagccttgtttccacgaatctggaagtgattcccggcactgttcccgtcaaggataaatacagggatatggtgtacagccggtttgtgactggcaccgaaaacaacagcttcttccgcagcgagacgctgaagctcattgagggcagccatgtgcctgttaaaggcggacaggtggcggtcataagcagggatttggctgaaaaaaacggcctgggtatcggagacagcttatctttgaccagggaagacggcgaaagaacagagcttaaaattattggattatttgaagtggtgaagcaggcacaggcgtatatcaacgtaaattcctttgataaactggaaaatcaaatttttacaggcattcaggcctgtcaggatgggctgccgcattccctgccaggctttcaaagcgtcatatttgaggtcaatgatccggcgcggcttgacgatatcgtatcacagctaaaagagaacgacgccatagactggcgggcctacaaggtggagactgataataaaacctacctggcagcggcagccccgcttgaaaaatcccagacactgatcacctccttccttctcctgatcgtgctggtcagcgccgtcgtactgtcccttatcctgaccatgtgggcgaaaagcaggattcacgaaacaggtgtactgctttccataggcttcgggaaagcttccatcatcggccaatacctggcggaggtgctctttattgcagcaattgcatttggattgtcttttttctccggcagccttatcgcaggcaggatcggaaacagcctgctgcagctgcagtacacccgggaacagtccatacaggagccggatgaaggcgaaaatggggtacaggtttccaggaagggtgacaggaatccggatgttgtgattagcgacaacggaaacggtggggaaccgatacctaataaggatttcccggaaccgctaagcgtgtctgttggccttgacagcatggtgaagctttatctcataggtttcgccatcatcactttttccgtgggggtatcctcggcggcggtcatgcggctgaagccgggggaaatcctggcgaaaatgagctgaagaaaggagaaacatcaaatgtctgttttagaaaccaggaatgttttttattcctatacaaagggaaacatcattttatcaggcataaacgctgtctttgaaacgggaaagctgcacgtgatcatcgggccgtccggttcaggcaaaacaacgcttctgtccctgctgggcgggctggattccccggcaaaagggaaaatcctgttcgatggagaagatatcgcggagcgtggactggaatatcaccggcggcagcatgtttctctgatttttcagagctataacctgatcgattacctgactcctgtggaaaatgtgaaattgaccgccagacaggatgccctgccggttctgaagagactggggctgtccgctgaggaagcagggcgcagcgtgctgaagctctccggcgggcagcagcagcgggtggctattgcccgtacactggcttccggtgctccttttatcctggctgatgaacccacaggcaatctggatgaggatacggcggccgaaataacgggtattttaatggaaagcgcccatgaacttgacagatgtgtaattgtagtgactcattccagggaactggcaaagcgggcggatatcgtatggaagctgaagggcggcagcctgcagagagtaagcccttgcctgagagcggatgttccgggacaggaggtgttcctatagcggcactattgatcgtcgaagacgataaaaaaacaaacgaggccatctgcgagtatctgaaatccgcaggtcatgagacgattccggcttacgatggagcagaggcgatacaaattttcagggaaaaaaagatagaccttgctgttttagatatcatgcttcccaaaataacggggcttgccgtattacatgaaatccggcggacaagccttctcccagtcctcatgctcaccgcgattgaagaggaagacacccaggtgcaaagctttgatgagcaggcggacgattacattaccaaacccttttccatggtgctgctgggaaaaaggatcacggcgctgctcagacgaagcgggcagggcgtgatcccggatacgatgacgtttggggaggtcacagtggatttttccggatattcggcctgggacagggaggggaaaattgaattgacaccaaaggagatcgatctgctgctgctgtttgtggagcataaaggcctggttcttaccagaaatcaaattctcgatgagctgtggggcgatgataacccgattattgaccggacgattgacacctatgttaaaaatctgcgcaaaaaatgcaggttcgaccgcatcattacggtaaaaggaatcggctataaatatgaggagaggaaatgaaaaagctgaagctttatccaaaaacatttttttatactctggggcttctgctgtttattgtattcatggcccatgcgctgctgtattttcttaccccgcaggtaccgctggaactgtcggcggatacaagccatgcagaaacaatgctcaccggttccattaatctgacgccgtatataaagcagatgattttaaaggttctgccgatctcactcggctgctgtatcctggtttccattctgtgttcccttctgttttcgaaacagatcacggttcctgtcaaacatatttcgacagtcaccgaacggatggcggggatggacaaaactgcggtctgcgaaatccatgcgcaggatgaaatcggcgtgctggcggataatatcaacgatttatatcaaaatctgctgacggccatcgaaagtcttgaaatggaaaaacaacgggttcaggaggcggaacgctccagggttgaattcctgcgggcggcttcacatgagcttaaaaccccattgacagccctgaatgccgtgctggaaaatatgattctgggcataggaaaatacagagattatgagacatatctgccggaatgcaaagaaatgacggagcagctgtcggatatggtacgggagatcctggaaacctcaaagctgggaagcccgatgaaaagcgaagcttgggcagaaaccgatttatccttattcctgctcccgctttgtgagccgtacgaacagattgcaaaggcccgcggacttattttcaggctggatttatcggctggtttttgcgccgttctgccgcagcggatattcggcaaagcggtatccaatattctcgccaatgccgtcgcttatacgaaagagggcggcacaatttcgctctgcttcagaaaatcggatctgattatagaaaatgaatgcacgccgattccggctgaggctttactgcatgtctttgaacctttttaccggcctgattatgcccgtaaccgggaagacggcggaaatgggctggggttatatattgttgacacactgttaaaggagatggagcttccctattcgtttcagccaatggagcagccggcggggatgaggtttgtgatttcactgaagggtgagcatacacggtgatacagttacaggtcattcggggcatctatatggcattttaagcctttttttgtttcagaataaattatgaggcagttaccttaaaaaaatacatactatccataatttttcctatttgcgggactcaaaaaagtatagtatgagatcaaccgtaaaaaccaaaagggacggaacaattagttttggaggaggataaaaaaatggtggaaatcacagaaatctctgcaatgctgcaaaaaggaaaggctaaaatcgtaaaggaactggtgcagcaggcgctggatgaaggacaggatcccaaagagattctcaatgacggactgctgtcaggtatgatgatcgtcggaacaaaatttaagaacaacgaagtattcgtacctgaagttcttgttgctgcaagagctatgaatgcaggtctgggaattcttgagcctaagctggtggaagtgggaaatgagccggtaggtaaggctgttatcggtaccgtaaaaggagaccttcacgatatcggcaagaacctggtggccatgatgctgaagggcgcaggattcgaggtgattgatgcaggtgttgacgtggatgcggaaacctttatcagcaaagcggaggaggttcatgcggatgttatctgtatgtcggcgcttctgacgaccacgatgcccaatatgcaggaatgtattgataaattaaaggaaaagggtcttcgggacaagtacattgtaatggtaggcggagctccggtaaatgacagctttgccaagaagataggtgccgattactatacaccggatgcggctactgctgccgaggttgccagaaacgcggtgactgcgcattaagcggcggcccgaaggagagatgtatgaatgcaatggaaagggtagtgacggctctgcagcataaggagccggacagagtgcctgtctatcctatattaagcggggtatcgagaaaactggtggatgcggactataaaacatggtcgacgaatgcggatgtctgcagccgggcacttttgaaagccagggaaaaatacgatcaggactgtattgtctcccttatcgatctgtcggtggaatgcgatgcatggggacaggaattgatttttcctgaaaatgaagcggctcatcctaattatcaaaattcattgatacaggatattgatgaatacagtaagattaagaaagcggactacaggaattcggaaagaatgatgatgcatatcgaaacctgtaaaaaactggtgaaggaagcaaatggggaatttccggtgattgcttttgttttcggacctctgggagttctgtccatgctgagaaaccagcaggatatgtatatggatctttatgatgatccggatgcggttaaagaggcggctggtgagattactgagacactgaaggactattgcagggctctcatggctacagggataaatggtttgatgtttgataccctgttttcatcaggatctattatgtccaaggagatgtggctggatatggaaggcccgtttgtcagggaactggcagaagtgacaagagaggccggaggcctggtcatgattcataactgcggtcagcgaatttattttgacgctcaaatcagtatgatgcatccggatgccatatcttttctatatcctcccgatgactgtgcggattttaaggaatgcaagaagaaatatggagataaggttaccctgattggttgcgttacacctgcgagcgccgtattaggtacggatgaggagtgggacgaggaatgcagaaactgtatggacgacatgatggagggcggtggctttatattggcaacaggctgcgagtatcctgcaaatgcctcctttgacagggctgaacgtatggtaaaccttgcaaaaacttatggaaggtatggtaaataaattttctcacacatgctgtttctgcggggagaagtcatcggtactgttttggcgtcattcctgtatattttttaaatacctttgaaaaataactctggtcatcaaaaccgcaggcgactgcaatgtcaataatgctgtattccgtgttgctgagcagccgtttgctttcctccacccgaaccatattcagatattccttgaaggaggaaccgctgcattgtttgaaaatggaagaaaaataggccggatgcaggtggactgcatccgccacttcttccagggtgatggaatgattgaagttcgtggaaatatagttcatggcttttttgatagtctcccggtttttgttcagggaataatcaaacagactgtctgtgaaggcttccacgatttcctgaagctttgcgcacaggaggtccagggtgtctatcagctgaaggcttttcagaaaagaattgttcagcttcagaatattgtctgtgggcgccccgccttctattgccacacgggagagcagggaacataattcaatggctcgtgccttgatataatccaggctgttcccttcggaaaataatacatagcccaggagatcattcagaatagcccttgcctggggaaggttgccggttttaaccttggtgatcagttcccgttctttttcgtaaggataatccaggaccgtcgtgtccatatttttataccgctggattgcttcacttattttggactgctgggaaagtatccggttattcagcttgagctgttccttgctttcatcaatcaggttgcagaagagaaaaaacagcagtttattgatgtggttgaccatttccggagagacaagcgcaatggatccggattcttcaaacagccggagcgtgtcgtcaatattgagatgatatttcttggaaatatcggaaatgagcgtggagtcaggctcgtccataaggaaagggccgagcaggatggaacccaggaatttatccttacagatcaggggatatacgatgtggtttaaatgggcatggcaggaaaaaatatagggttctcccagggaaatcgcccttttgctcgcgcccacatgcattttctggcaggtgtcttccggaggaagatgtttttggaaaaaggagcagaacttgcccgtgtctccaaagctttccagaaaattgccgtcttcatcaatgacctgaatgggtagcttgatgcagccgtaaaaggcttctactatattatgaagggtatctttatcaactacggaatataaggactgagacatattgccatctcctttgtaacggattattttgctgctggtttgagtataccacgtgatacaaagaaattccataaacctaaaataaatacctacattcttaagtttttcccaattgacataagcttaaggagaaagaaagagcggcctgttcaagcgggcggatgggaagatatatgaaagttacagattttgcggtacagttcagcagggagaatatccttcacctgattgattgctatgaggattctcccatatatgaggaagtgcttgaggaatatgaaaggatgacgcaggaggcttatgaaagaatggagcctgcggcagtgctggagttcgggaaaataccgaaggaagcagcaagccctgcggcgccggaaggtacccgggcgctttttttgattgtaacagttggaaaaagaataagtgaatggtctacagcacttttcggagagggcagatatctggagggaatgctggcggatgctttcgcagatgattatctcatgcaggcttcagagagcctgcagccgcttgtgagaagtatctgcggggagaaacagctggggatatccagacggctggaagcgccgaccggtatagggatggaagcgcagaaggccgcctatgaggcgacggatgcagggccgattctgggtatggatatcacaggcagctttatgctttctcccgtaaaatcaacctgccagatttatctgctgaaggaaaacagcacggaataccatatggatcataactgcagggagtgccccaacaaagactgtaaaatgaggcatgtggccccgatcaggctggaggtaaggacaaacggggaatcccatatcctaataagcagagacgaaaagaccgtgctggaaattctcagggagcaggggatttatgtgcctgcggtctgtgccgggagaggatcctgcgggaaatgccggatcagggtggcggagggagaggcagcggttaccccttcggatgaaagaatctttactccgcagcagctgagtcagggataccgtctggcctgtacctgttatccgatcggagatatgacagtggtaacagaggaagaagccgagaagaaaatggatataatcggcacgatatcccacaggaaaacggatggaacggaagctgacggttccggcccggtcatggtgggaatagatatcggaacaacaaccatagccatggagctcgtcgatatggattccggtgcggaaatagacagttacctgtgcattaacaggcagagaagatatggagcggatgtgatcagcagaatccaggcctccgtggaaggcaaaaaggaagaactgcaggaaagtatccggcaggatctttttaccggcctggaaaagcttacccggggaggagagattgtaccggaaaaagtggtgattgcaggaaatactacaatgattcatctgctgatgggatatccctgtgatacgttaggtgtttatccttttatccctcatcagattcagcggattgaaagcacgctgggagaggttctgggagagaatgtgacggaaccgcttcgcacggcacagttatgtacggcacacttgtaccggacaaaggtttggattcttccgggtatttccacttttgtaggggcggatatcgtttcggatatcctttcctgcgggctggcggaatcagaaaaggtaagtatgctgattgatctgggaaccaacggggaaatgggaatcggaaaccgggagcgtattcttgtcacctccacggcagcagggccggcctttgaaggaggaaatattgtacatggctccggcagtataccgggagccatatgtaatgtggagatagaagacggcagggcgcgggtacgcaccattcagaatgagccgccttccggtatctgcggtacgggagcgattgagactctttatgaactgctgcaggcgggcctggtggatgaaacgggtttgctggaggaggattatgaggaggacggctttgaactggcgaaaggcagggacggagagccgatttgcttttaccagaaggatatccgcgagcttcagcttgccaaatccgcagtccgggccgggctggaaacgctgcttctgcgttatgaaataagcccggaggatgtggataaggtatatctggccggaggcttcggttaccggatggatgttgaaaaggcagtgggcatcggcctgataccggaagtatttacagataagatccgggtgattggaaacggcgccctggagggtgccgtacgctatggaagggaagagggtgctatggatctggcggaggatattgtgaagatttcttccgagataggtctttcatcagataaagcgtttaatgatctgtatatgcagcatatgtatttcgaatgcagctgagttacccataaaaaatgccctgcggagaagttgattttccgcggggcatttgactcaggctttccaattattttcaatttcttcccgtatgagagcgacgtaacgtctggccttaggaatgttgttgtgaatggtatacacatccctttgagtgatttccattttgcagcctcttgctgccgtaaggcttttccggatatgggcgcggaaagcgtcttcatccaaaacaggatctacaccgaggaaattcgggctgggctttctgtggtatatcaccttggagccccgcagcctttctcccataaattcttcattgcaccagggagaaatggacacctttctcagattggtaagcctgcttaaacatttgtcccatataggatctaccggttcacagcagccataggaaagaagtccataggaagaggcaattttttcatagcaggggaagatgaattcctcatacatatcaggcgaaatccccacggtttcctgggaatccataaagccccagacatccttcgttgtgaacgggcgtttttcccactcatcccagccgggaagctctgtggtgaagctccaggttccctggcccacgccttcgaaggtggtggtgggaaggatcaggcgtttctcttccagcattttataataggcaagcgtgtcgtccgcaatgcgccccatcatttctttaaataaatccggataatcatacatggcaaacatcatgttttccatgctcataaaatgcaccagcatttgggtgggaacgctgtagagacaggacatctgcatttttacaggaagaatatcacctatcgcttcttccacagccgctcttttctgttccgtagtttccaggttcactccataacggctgggtttcagcttttcataatcctcttccagatcttcaataatggattcaaaatgatgccccaggctttctttaccgctggcatcctgcgtatggtcaacatgaatctgtatgccgaacaattcaaaaaaagtatcatattccatcgggaaataatccggtgttactctgtcatcatcaaacaattcctgattcagaaagttactgtacaaagcgatttccacctgcttcgcaaaagctccttcacatttcaggagcggaggaatgatttcctgggaaaaggtgcccatttccaggtgaatcataggcttttctccctgcagggcattgtgcctgtaccattcctgtattctggctttgttggaatccatatttgccagctccagctgtttttttgcggtttctctcagaatctgtttatccttgtccgatatcaggtattccatggcaatcctcctgtgattacgttccggcttacgtctccattgtgcaggggagaagaacgcacccgcacaatagagacgggaaccggagcataatatattttataatccgattttatcatagtttcagttgacttacattttaaataattgatatgatgtatataaaaattgcgctgtgtctgcgggcttatatagagatacgaatacgggctgcagccagccgggacggaggctatatgaatccaaacacccaggaacccggtcctttctcagaaacctatttccatacacccagccctcttgccaaaaaaacattcctttatccggtatgcctcggccattattattgcgatgaagaatattgtgtggcgcggaataactatgacagctttctgatgatgcttgtggtaaaggggcagggatatgcggaatctctgggagaaaaagccttccgtaagaaaataggggagaaacagctggttttgatggattgctatgcgccgcatatgtatggggccgacagtgaaatggaattttactggattcattttgacggaatcaatgcaggggcttatttccggtatcttacggaagtgtacggaacggtgcttaccttaacggacagtcaggctaatgtattccttcataaattcaggatgctgctggaagccctttcttccgatcaggggattgccgagaatctgctgggatattttgtgacggatcttcttacctttccgtccggactgacaggagccaggacggtgtccggttccgaagccgcacaggaagacaggttcaccagggaactgggcaaggctgtttcctatatgcgccagcatttcatggaggaaattaccattgaggatctggcagactgcgtttctgtcagcccctatcatttcatccgtctttttaaaaagcagtacgggatcacgccccaccagtaccttttgtccatgcgtctggactgtgccagattttatctgcgctccggggataaaacggttaaggaaattgcgttttcctgcggcttccaaagtgaaaataatttttgcgttgcctttaaaaagcagacgggtatgacacctaccaattaccggcatgggatggaaacaagagaattattctgacagggtaaaagctatatgatatcagttcagccaatggccggactgatatatttttatataatgggaaaacgttgttggtattgccaaaattgcgttcttgtattataattgttttatcttatttatctatagatatcatggcaggtctgccgacagattccgatttgaaatggtgaacaaaagaggagggatgcttatggatgatttctggctgtaatggttgaaggaattaccggaaatatgataaaataaaggagaataggaatgacggagagaaaaagcaaaatgctcccccttagcgagttgacccttttggatcgttttttgtttgatgcggctatggaggataaggatttccataagagtgtcctgcagattattttaggaaaggaaatcactttcctgaccaaaaatgaaacggagaaagagctgcgggtcagtcctctgttgcgttccatccgtatggatgtgtatgcaatggatgaggatggaattatttataattcggaaatgcagaaacagttgaagtatgatttacccaagagaagcagatattatcagggaatgctggattcttccctgctggagccgggctccatccggtttagtttgctgaatgattcttatattataattataacgccttatgatgtttttggccttgggaaatacaggtataccttccgggccagatgtgatgaggaattgtcctgtattttgccggatggggcagtgcgtattttcctgaatacaaggggaaagaaccgtgaggaagttggcgatgagttggcatggtttctggaatatgcggagaaaacggatgaggaaaccgtcaggaagtcaggaagtgaggtcctccggagaatccatgagcatatctgtaaattgaaagccagtgaagagatgggagtgaggtatatgcaggcatgggaagaaaaagtgaaggaacgggaagatggcagggaagaaggccttaaggaaggaatattcagaacaaaaagggttctgaagcttgctgccgaggggaagaaaaaagaagaaattgcggaaatgtgcggaatcactgtagatgaagtggctgaaatactggagtaatgactgtaattcaggtatcagaggaagactgcatgttactggtcacggagtgaacagtaacaactgaatcgaaacggttataaggcggcttaagaaaaactttgcaaatctttatattttctattataatttacgcgaaggtgttaagcagtctgcaaaagaaaagaggtaacctatggatagtgataataagagcggggaagtacagtttacggagagaaaaagatggctgtttttcggcctgccctttacctttacggtatatacaattaaggatgatatgataacagtttcggaaggcttcctcaacaaaaaggaaaatgactgttatatgtataaggttcaggatgtggaactgatacagtccctgatggaacgtattgtgggcatcggcacggtgaaatgctatacaggcgacaccacgaatccactgctgcttctgactcatgtaaaaaatgcaaaggcaattaaaaactacatattggaagcttctgaaaaggcgaggatccgccgccgcacaatgaatatgctcaatattggggcagagggcgcggatgacggtgactttgacaatgacagagtataagaaggcttgaaacaaaatggagcgccttacatagaaatggattgggagataagatgcggaaaaattttttctgcatctttttctgtgaagatataattattttttgaaaaatgccgactggaataaaaggagagtgatggaatggaacttgatatgacaaaggggagcccccttaaactgattacgaaatttataattcccattattatcggaaatatattccagcagctgtacagcctggtggatactgttattgtaggaagatatgtaggagtaaaggcacttgccgccgttggagcgacaggaactatcatgtttctgattcttggcttcctgcagggactgactaccgggtttacgattctgacggcccagcgtttcggagccggggatatggaaggaatgaagaaaagtgtgggcaacgccgcagtgctttccctgatcgttaccgtggtcatgaccctgggcagtgtcctgatcatggactggctgctgcgggtcatgagaacgcccgtggatatcatggctatgtccaaaacatatattcttattatctgctggggtatgggctttaatgtactttataacctcctttccagtatactccgggcagtggggaacagtaaggtccctctgtactttcttatactatccgcggggatcaatattgcgggagacctgatactgattatctgctttaagatgggcgtggcaggcgctgcgatagctacgattgcttcacagggtatatcggggtttttgtgtttggtctatatgataaagaaggttcccatgctttctctgagcagggagcatctgcgtctggatctctggtgtgtgcgcaaccagatttccataggaatccccatggcactgcagttctctattacggcgatcggcacgataatggtacaggtggcactgaatatgctgggttccaccgtagtggccgcatataccgccgcctgcaaggtagaacagctggtaacccaggtattcgccgccatgggtatgacaatggctacctactgcggacagaacagaggcatcaatgatctggatcggattcgcaaaggaagccgcattgccttttggatgtccgccatttacggcgtaatcatttacgcagtggtagtattggcgcttccgctgatcattcagctgtttgtaaccggggacagttcggaggtacttggatatgcccgcacttatatcatcatctgcggggcattctttatccccctgggaatgatttttatttacaggaatgtcatgcagagctgcggatttgccctgatgccgatgatgggcggagtcgtggaactggtgagccgtgcagccctggcaatcgtagcggcagagctcctcagctacgagggagtctgcgccgccaatgccagcgcatggtgcctgggaggcatattcctttatatcgcttaccgctttaccatgaaaaagatggaacgggataagctgcttgccgaagaagatacgcagcccgtttcttctatataaagaagctatgcaccggcagacagacacaacagttcagcatttctcccaccgccaggcccatgcttcctgcccggtcaaacctttctttctctccgctgttggctccggccaggcagaggtccttaaaggggacgctttcgctcggataaacacgcagcggtactaaggttgcacagtacgcaacctaaggaccggcgagtttatacgccccttacaggatcctctgcctggccggagccaacagcggagagaaagaaaggtttgaccgggcaggaagcatgggcctggcggtgagagaaatgctgaactgttacagacggacaggatcatttcctgtccgttattgcatgttccatgagaagaccggtaataatccaacaaggggcataatcaagccggatcaacctgccgatattccagcgggctcttccgtaattccagggacataattctttcttttgaaggaaaaatcccgaagcatattccgccgtaaaaatgcagagggcataaatacagccccgcaccagccaatgacacccctttaccagggagcatacaggctttaacagacagcctgccccgtaaatagggaacatccacaaggaagtagtcccctggagagacatcttcctctgctggagagaatgaagcgcagtaaatgtaatttcaaggcaccagccaaggatgccgcatttgataaaatctttaaataatttttgcatgctaatattttgaccgcttattctttttttatacgaattgtgctatagtgtgtttgaaatcagggctgccatcgtacctgcctttctgcggacgcccttcttttgttcctcccgccctttccgccctgcggcggctgtgtatgtgtgttccaatccatgggaaaaaacggtgatgtttcttaatgtcccgttttacaggaagtctgccgtccttagcggcttgtctgacgagcataagcggctaaggccattgtgtttaaaatcgcatgcgaggagttttgccgcgttggcagaattccggtgaaacggaacatttagaaacaccccgtttttgaggttggattggaacacacatacacagccgccgcagggcggaaagggcgggaggaacaaaagaagggcgtccgcagaaaggcagatacgacggcagcggcaaaggaggagaaggaagatgaattatcagcaggcgctggcttatgcggaggagtgcggacaatacggctgtgttccgggtcttgaaaatatgcgggaattgctgggcaggcttggaaatcctcaggaggagctggcttttgtacatatagcgggatcaaacggaaaaggctccgtgatgaattttatttccacggttttgacggaaggcggatataaaacgggcaggtatatttctcctaccatctttgaatatcgggagcgttttcagataaacggaaaatatatcagcaaagcggagttggggaagttcatggaaccggtacgggatgcggcggagactatggcggcggaaggaaaaaatcaccccaccgcttttgaaatggaaaccgctctggcctttttatggttccgggagaagaaatgtgatatcgttgtcctggaaaccgggatggggggcctgctggatgccacgaatgtgattccggccccgcttctttgtgtgctgacctccatcagtatggagcatatggctttcctgggcgatacactggaaaaaatagcggagcataaggcaggaatcattaagcagggcagcagtgtggtgacagtgaagcagcggcccgaagccatgaaggtgatcgaggatgcctgtaagagcaaagaggcccctctttctgtcctggatccggataaaatatccgctataaagtacggcctggaaaaacagcgcttcagctatgggaatcacaaagggctggaaatcaccatggccggaatctatcagatagaaaactgtgcgctggcagtgtcggctcttgaccggctgggagaactgggcttcccggtgaaggaagaaaaactgcggctgggcctgctgcatgccaaatggcagggaagatttgaggtcatcgggaaaaagcctctctttgtggcagacggtgctcataacgaggatggcgcggctaaactggcggagtccatacagttttattttacaaatagaagaatcatatatataatgggaatattgaaggataaggaaacagaaaaaatgatccgcagcacctgtccgtatgcggaggccgtcattactgtggctgctccggggaatcccagggctgttcccgcatatgagctggcaggggaggtccggcggtatcatggaaatgtgacagctgcggacagcctggaggaagccgtggaaatggcccggctgctggccgggaaagatgatgttatccttgctttcggctccctctcttttctgggggatctgattagaatcgcagaaaatggtgcagtcaggagagacacgcatggtagataagtctaaaattgaagaggcggtgaagctgcttctggagggaatcggggaagatgtggatcgggaagggctcagggaaacgcctgtgaggatcgcccggatgtatgaagaaattttcggagggatggatgaggatccggccgtccctttgtccaagcagttccaggcggaaaacgcgggaatcgtcctggaaaaggatattaccttttattccacctgtgaacatcatctgatgccttttttcgggaaggcccatgttgcctatcttccggccggtaaggtggtgggactgagcaaactggcaagaacggtggaaatatttgccagaaggccgcagcttcaggaaaagctgacagcccaggtggcggatgccatgatggattatcttcagcccaggggcgtaatgataatgctggaggcggagcatatgtgcatgaccatgcgcggagtcaaaaagccgggcagtaagaccgtgacagtggcggtaagaggcgcatttgaagaaaacagcgggctgcaggaaaccttttatcacatgctggggagataaaggcccggcaggcgctggaaagattaaagataaagaaggatacatatggacagaatcaacggaataatcaggaatgcctgttatcaggaatgtctgcagaaaaacagggcgcatgaggaaacgcgtattttctgcaggcatgatatggcccatttcctggatgtggcccggctggcatggattgagaatctggagcgcggaagcgggattgacagggagcttgtttatgcggcggccctgctgcatgactgcgggcgtttccggcagtatgaggatgccgttccccatgaacaggccagcggggagttggctgcgggaattttggaggcctgcggctttacgccggaagaaaaagaagagatcttagctgccatacttcggcatcgtgataaggaaatggctgaagaacgggggctgtcaggcctgatctatcgtgccgataaacagagccggagctgttttgcctgtcctgccgagggggaatgtgactggagcagggaaaaaaagaacttgctgctgcggatgtgaatggaagaaagatgagggaaaagatatgtatataggcggaaaagagtttgctgacagaggaaagacatatattatgggaatcctgaacgttacaccggattccttttctgatggaggaagatacaaccatctggatgctgcgctgagacatgtggaaactatgataaaggatggcatggacatcctggatatcggaggggagtcaaccaggccgggttatatcaggatttccgatgatgaagaggccgaaagggtggttccggtaatagaggcggtcaaaagccgttttgatgtcccggtttctctggatacctataaatatcaggtggcccgggcgggaatacaggcgggtgcagatttgattaatgatatatggggattgaaatacgacggcggaaagatggcggaaaccatagctaagagcgggctgccctgctgcctgatgcataaccgggccgaggcggactacactgattttctggaggacatggcctctgatatggcggaaaccttgagaatagcggaagcggcgggaatcagggatgacaggatcattttggatccgggcgttggttttggcaagacttatgaaaataatctggagattatcaacagtctggaaagcctgcacatttttaactgccctctgcttctgggaacatcccgtaaatcggttatcgggctggcgctggatctgcctgccggagaacggatggagggaactctggttaccagcgtgtttggtgtgataaaagggtgttcctttctcagggtgcatgatgtgaaggaaaataaaagggcggtacagatggcggaagctattctttcgggaggaaaaagctgacagtaactttttgatctttaagtttgcgtctgtgcgatagacagacaggagggttgacaggaggataaaggatgaaagatcaaatacggataacaggacttgaggtatatgcgcatcatggagtttttcccgaagaaaaagaaaaagggcagcatttcttcctggacgcggttctttatacggatatcagaaaggccggcctgacggatgatttggactgcgccaccgactacggacaggtatgtaagctcataaaccaggtgatgaccggacagacctatgatctgatagaacgggcggcggagcgggtggcgcaggaaattttactgacgtttcccctggtggagcggctggagctggagctgcataagccggaagcccctattccgtatcctttcggggatgtgtcggtaaagattgaaagaggctggcataaggtgtacattgcttttggttccaatatgggggagaaggaatattatctggaaaaagggctggatgaactgaaaaggcatccattatgcaagtcggggaaaatgtcatccatttaccgcacctcaccttacggaggggtggagcaggaggatttccttaatggcgtgctggagctttataccttgctgagcccttttgaactgttggaaaaaatgcagcaggtggaaaacctggcaggacgtgagcggaaagtccactggggaccgaggactcttgatttggatatgcttctgtatgatgatcagatcatcgattcggaaaagctgaccgtgccccatgcggatatgcaaaacagggattttgttctcgtgccgttatgcgagatagcgccttatgtgaggcatccgtctacggggaaaaccataaaacagctgctggaaacgctgcagatgggcggagaacgtcatgtgctggaataggaaattatttaaattttatgtaaaataacatattattttattgcatataaagagggaacagttgtactataaataaaacataccggattagggaagggttgagaatctgaggttttcagcctccctgatttgcaggcggaaacagccgcatgcaaaagaggacggataggagtaaaacatggatttaggagatttaagaacgcagatcgatgcggtggatgaacagattgtagacctgtatgaaagaaggatggatatctgcagacaggtggctgaagtgaagattgagacaggcaaaaaagtgtttgaccgggatcgggagaaggaaaagattgccaaggtcaaatcgcttacccacactgattttaacaagaccggaatcggggaattgtttgagcagatcatgtccatgagccgcaagctgcagtatcagcttctgacagagaaggggacgatagggcgcctgccttttatcggcgtggattccttaggggacgaccgggtgcgcgtcgtgttccagggtgcggagggagcttactcccaggcagccatgcatcagtatttcggggatgcggttaacagcttccatgtggataccttccgggatgcctgctgtgcgatcgaagagggaagcgctgattttgcggtgcttcccattgaaaattccacggcgggaattgtaaatgaaatctatgatctgcttgtggagttcgaaaattatatcgtgggagagcagattattaaaatagagcattgccttttgggagtgccggggggcaggatagaggatatcaggacggtatattcccatccccagtccctgatgcagagcgcccgtttcctttcggagcatgactggaagcagatcagcctgccgaacaacgcatttgcagccagaaaggtggcggaagaaaaggatcccagccaggcggctatcgccggagaatatgcgggcagggtatacggccttgaggtgctgaaaaagccggttaaccagtccgacaccaattccacacgttttatcattatcaccaatcagaagattttccgcaaagatgcgaagaaggtgagcatctgctttgaaatcccccatgaaagcggctccctgtaccatatgctttctcattttatctacaacaacctgaatatgaccaagattgaaagccgtccgatagaagggcgcaactgggaataccgttttttcattgattttgacggcaatcttgcggacagcgcggtcaaaaatgccctgcgcgggctgagggatgaggccaggaatatgaaaattctcggtaattactgataagatgagagagggaatatgggatgagagagaaagaattaattgtatataaagattttgggttagacagccgtctccttatggatatggtatggctgatggagcattacggaagcggtgaagaaggagttcagaaggagagcgcccttttgtatgactgcatgcacggccttttggaaatggcgggcagccatggcttttccggcaatctctggcactgctatctcacgaacctgctggtgaacaatgaaaacagctacagccgtgcgtgtgaaatccggggaaaagtggaagggaccatcaacgaggccgtacttcatgacataatcatttttaaggaattttttgattatgattttacggatatgatggagaagctgcaggttcccgccttttctcttgtcctttcctatgaagggaatatgcaggagagcaaggtatacaatacccgtatccgggacaggatatgtacgctcgccgtgcgtttcaaggaaaacaggacgccggaggaaatgaaggataccctgacggaattttataaggaatatggcgtgggaaaattcggcctgcacaaggctttccgtatctcccataaagaggacgaaacgctgattgagccgattctgaatatcgcccatgtccagctgggggatctgataggctacgagacggccaagaaaaaactggtagacaatacggaagcctttgtaaaagggaaaaaggccaataactgccttttatacggagatgcgggaacgggcaaatcctcaagcatcaaagcaattgccaatgcatattattctcagggactgcgcattattgaggtatataagcatcagttccaggacttaaataatgtaatcgcccaaatcaagaacagaaattataaatttatcatttatatggatgatttaagctttgaggattttgagattgaatataaatatctgaaggccgtgatagaaggcgggctggaaaagaagccggccaacgtgctgatttatgcgacttccaaccgaagacatctggtacgtgagaaattcagcgataaaagagagttggatgatgatctgcataataatgacacagtacaggaaaaattatcactggtatccaggtttggggtgaccatttatttcggcgccccggataaatcccagttccaggatattgtaaaggctcttgctgcgcgctatggcctgaccatgccggaggaagaactgctggcagaagccaataaatgggaactgttccacggagggctttccggaaggacggcgcagcagttcattgattatctggccgggtgcgaaagcgctgccggcgggcagcagtgaggaaaggaagggatgcggagtgaagacttttgcagctattgacgtaggttcttatgagctatccatgaaaatatttgaattttcaccgaaaatcggcattcgggaaattgaccatatccgtcacaggattgatttgggaaacgatacctttgccacgggaaaaatcagttatgaaaaggtggacgaactctgccgcgtcctccgggaatttgtggacatcatgcggggctataaggtggaggatttcaaggcttacggcaccagcgccatcagggaaacggaaaataccatgatagtgctggatcagatccgccagcgcacaggaatccgcattgaggtgctgagtaattccgagcagaggttcctggattataaatccattgctctcaagggacaggattttaataaaatcatcgaaaaaggaacggccatcgttgatatcgggggcggcagcattcaggtgtccctgtttgacaaggatacgcttgtggctacccagaaccttcgtctcggcgtactccgcctgcaggagctgctgaataagctgaacgcgaagccgtccaaatatgaggggctgctggaagagattatcgaaagccagctgtccgtttttaaaaggatgtatctgaaggatcggaccattgataatatcattattgtggatgattatgtttcggccctgatacagaagcgccttaccggctcacagacgccgggatatgtggacagcgcaagctatgaaatgtttatgcagatcatgcgcacacatacaaaggaagagattgcggcaaggttcggaatttccacggaaagcattcctctgatatttatttccgctgtcctcatctaccgggtggccctgcttatggaagcgaagctgctgtgggcgccgggagtgacgctttgcgacggtattgcatatgagtttgcggaaaaaaataagattgtcgggccgaagcatgatttcgagcaggatattgtggcgtgcgcccgaaatatcagcaaaagatttatgggaagcagacgaagaggagaaacgctggaatatatctgcaccaccatttttgacagcatgaaaaaggtacacggccttggaaaaagggagcgcctgctgcttcggatagccgccctgctccacgactgcgggaaatatatcagcatggtgaatctgggcgaatgctcttacagtattgtcatggcaacggaaatcataggcctttcccataaggagagggagatcgtagccaatgtggtgaaatataaccatcaggaatttgattattatgaggagctgggaacaacaacgacgctggatccccaggcctatctgactatcgccaagctgacggctattattcgtgtggccaatggcctggatcgaagccataaacagaaatttaaggatttcaagaccaccctcagggaggatcagctgatattcactgtgaacactgcggaggatatcactctggagagagggctgtttgaagcaaaggcctcattttttgaagaagtattcagtgtgcatcctgtcattaagcagaaaaaaatcatttaaaacggagaaaagattatggcggagaaaaaagattatctggagcctgagctctataccaacagggaactgagctggatcctttttaacaaaagagtgctgtcggaagcaagagataaacagatccctctttttgaacgattaaaatttttaagcatcaccgcttccaatctggatgagttttttatggtgcgcgttgcgtccttaaaggatatggtgaatgccaaatataccaaaaaggatattgccggcctgactgccgcccagcagctggagcagctgaacgtggtgacccatgatctggtttcccagcaatattctacatacaatcgttctctgctgcctctgctgaaggcaaatggactgactgttgtggagcagcatgaaaatctgaatgaagaacaggctgcctatgtggatgcctattttgatgataatgtctaccccgtcctgacccccatggcggtggattcctccaggcccttccctctgattcgcaacaagtccctgaatatcggggcgctgctttccaaacgcaaggaaaagggagaactggaattcgctacggtgcaggtccccagcgtcctgtcacgtattgtgccgattccggcggaaaaagccggtgaaaaggccgtcatccttctggaggaggtcatagaacggaatatttccagactgtttctgaattatgacgtggtatgctcccatcccttccgtatcatgaggaatgcggatttgaccatcgatgaggacgaagcggaggatttgctgaaggaaattgaaaagcagctgaaaaagaggcagtggggacaggcgatccggctggaagtggaagccggtgtggataagcgcctgctgcgcatgatcaaggatgagctttccattgaggaagaggatatttaccgtatcgacggccctctggatctcaccttcctgatgaaaatgtacgggatggaaggctttgcccatctgaaggaagagaagtatgttccccagccggtaccggaattcatggaggagggaagtgtctttgaaaagctgagagaaggagatatcctgcttcatcatcccttccagaccttcgaacctgtggtgcagtttataagagaagccgccaaggatccggacgtgctggcgatcaagcagactctttaccgtgtcagcggcaattcccccatcatcgcggcattggcccaggcggcggaaaacgggaaacaggtttccgtattggtggagctgaaggcccgttttgatgaagaaaataatattgtatgggcgaaaaagctggaaaaagccggctgtcatgttatatacggtctggtgggcttaaagacccacagcaagataacgctggtggtccgcagggaagaggacggcatccgccgttacgtgcatctgggaaccggaaattataatgacgccaccgcaaagctgtatacggatatcggtatgatgacctgttccgaggctatcggagaggatgccacagctgtattcaacatgctgtcaggctattcggagcctctttcctggaataagctttctctggccccgctgtggctgaaggataaattcctgtatctgatcgccagagagataaagaacgctaaggcgggggaacagggccatatcatagccaaaatgaattccctctgcgacagggatatcatagccgccctgtatgaagccagcgcggcaggagtgaagattgaactcattgtccgcggaatctgctgcctgaaggtggggattccggatgtcagtgaaaatatttccgtccgttccatcgtaggaaccttcctggaacacagccgtattttttattttgaaaatgggggcaacagtgaagtctattgctccagtgcggactggatgcccagaaacctggaacggcgtgtggaaatcatgttcccggtggaggatcccaggctgaaggaaaaggtgatgcatattctggaggtacagcttcgggatacggtaaaagcccatctgcttcagccggacggcagctatgaaaaagtggatcgcaggggaaaagaaaccttcaattcccaggaagccttctgtatggaagcgatagaagcggccaaagcacaggaagaacctcatgacggcagggtttttatcccggaaaagcatgtggaaatggaataacaggataaaaggagtttgtcggcatgaaaaagaagataatactggcgtccgcatcacccagaaggcaggagcttctgacgcagattggcctggactttgaagttcatcccagtgactgggaggagaagacggaaaaagaacttcccggagaggtggtacaggagctttccttccataaggccatggaagtatatcataggttggccggcaccggggaaagccttgctgaagaatccctggtggtaataggagcggacacgatagtagcctgccaggggcagatcctgggcaagcccggagataaggaacgggcggcagggatgctgcgcctgcttcagggaggcgttcatcaggtctataccggcgtttccctggtatggcaggaacaggggaaaacagagagcttttccttctatgagtgtacagatgtacgggtttttccaatgaaggaagaggaaattgccggctacgtggaaaccggggagccgatggataaggcgggagcctatgggatacagggccgttttgcggcttttatccggggaattgacggagattataataatgtggtgggccttccggtgggaaggctttatcaggaaatgaaaaaaagagaattcatttaggagaaaggccttgggacgatgaaaaaagctgtaatttttgatttggacggcacgctggccaacacaatagagtcccttacctattgcggaaacagggcattaagaaaattcgggctgcctgaattcgaagaggcggattataaatattttgtgggagacggagccgccgttttggtgcgccgtgccctggataaagccggcgataccggccttatccattttcaggaagtgtttgaggaatactccaggctgtttgagaaggactgtatgtaccatgtaaggccctatgaaggaatcagggagcttttggaggaactgaagaaaagacagatccgcattgcagtcctttccaacaaggcccatgagaacagcattcaggtagtggaaaccctgtttggcgcaggatattttgactggatacaggggcagatggacggcgtccctaaaaagccggatcccgccggagtatatcagattcagaaaaagctggggctgccgaaggaagcctttctctatacgggggataccagtgtggacatgaagaccggtaaggcggcggggatgtttaccgtcggagttctgtggggcttccgtgacaggcaggaactggaggaaaaccatgcggacgtgattatcgaaaggccggctgagcttctttcgtttctgtagaaaaagttgtccgaaccgagaatgacaataaccatgcgatggcggaaacatccgcctgctggcaggaaaggctgaaagaaacatgattaagttaattgcttctgatattgacggaacgttgatcccggattccacacccgacctgtatccggaaatggtggaagaaatcaaaaaactgacggacaggggaatccttttctgcggggcgagcggaaggcagcttgccagcatccgcagagtattccgcgaggtggaagaccaaatctgttacattgcggaaaatggggcacatgtatattataaggggaaggatctcgcacttaccgccatgaagcctgaatatgccaggcagatcgtggaacagctccgcggccttggcagcgaatatgaatttaccgtatcaactccccacggaagcctgctggaaaccaaaaacaggctcttcctggatatgatgaaatatggataccataatattttccgccaggttgaagatgtactggcggaagaggaagtaattctgaaaatagctgtttaccacagaggaagcatccggcagcttggagaagaagtattgattccccggtggggcggccttgttaaaacctgcgtggccggtgaggagtgggtggatttcatggatgcctcggtggataagggaaatgccctgcggacattacagcaggtttttggcgttgccaaagaagaaaccatggcatttggagacaatacgaatgatatcggcctgatgcaggcagccggtctcagctatgcggtggaaaacgccaggccggaagtgaaggaagccgcccgttttacctgcccttcttacctggaaaagggtgtgtggaagacaattatggagagatgtgggaaagaatcataacaagttcagcctgctcagaatgaaaatagaattgtcttaattaatacaaaaaagtcatcatggtttgccctataaacagcagaagccatgatggcctttttctttcctataatatccggttcggttccttcaaattacgtaagtatcaatcccaataatgccgtaccctttcctgagcctcctgttcactgatgttaaaccgaagtttcagtttttctgccgtctgttcaaaggtcaggttcatttctttacagatttctataattccttgttctattccctgttctattcccagctttattccctgttctatcccctgggcaattccttcttccctgccgctcttatactcgcttgcacggatttttctcatttcctcttcttcattgtattcaaagattgacactgctatcacctccgctctttgtgccgacaggaaatctgccagaatgccttctctgatgcattccgttactgcccgctcaaccgcttcctcaattcgcatgctctttgcatattttctgacccgatctacgtactggctgtattccttcaatgtcctgcatttttccatcaaatctttattgtggcccaaattgatgttcagcatgagtaccttcagttccagctccggttccgccgtttctttttcaaaagcatctgacagacacaggatttgcctttccggctgctcccctgtgccattgtaaaatacaacgaaccggggcaccggaattttcaccagtgtggaagagtagattgtctcatcccgcgcatatttttccagctgtttggcaatgtataccaaatccctcagcggcatattgggattatatgttgcctggtgctcgtacagattcagctcagaatccagcaggaacgagatatcgttcttaaaattcatatatattgcattgtccagggtgcagattgtcaggccgtccgggctgttatacgcggaaccattcagcgcgttgtacaattccagcaattccttcttttcccgaaatagcattcggaaaaccgtatccttttgatttcttactacgtgcagttcttctaccataagctgctcctttctgtttgtgtacggagcagccttctcattcagccgctcctgctttctttgttggatagtaagcatagagtttctgaattgagaatagaaattagacggcacatatagccaagattcgttagaaatttatgcttgcgtttattttatcactacttttacgtaaaatcaacatttcctgtcgggaattttctttgtcgctagaatgccaaagtaaattccagttcatatatcctaccagatttaagtttgacactccttcctttacaatggacattgcagtatgtctgttggaaaggagtttttatgtccaaatcaattcatacacaaaaacatatgactctctctgatagaatctacatcgaacaggctctgtctaatcatggttccttcaaagatatagctgccgttttgaaaaaggatccttccactatctctaaagagattcgaaaacatagaaggcctaaagacggcagtcattatcatctgaaaaataattgtgctctgctttcctcctgcaattgcagccgtatatgtgatggcaaactttgtaattatctttgcaagcgcagcaaatcctgtgactgcacaaagcattgcccggatttcttcccttatctttgtccgaaactcaaaaagcctccctatgtctgcaatggctgctccaatcatgcctgccgacacgataagtttttctatcgggccaaagatgcgtatacttcttatgaacagaccaagcatgaatgcagacagggaattaatcttaccccggaagaaagagctgccttagacgagcttgtggcacctctcattctcaacggacaaaccatggatcatatttttacggaacacaaagaagaaatcccctgctcggaacgcactctttatcgttacattgattccggtattctttccgtaagaaacattgatcttccaagaaaagtaaaatataaaccgcgcaggcagtctgacacttccgaaaagttaacgagagaatgtaccatcggcagaacctacaccgattttcttgaatatctcgaacagtatcctgaaacaaacgtggttgaaatggatacggtagttggtccggagccgggtaaagttattcttaccatgctttttagaaactgtacctttatgctagcttttctcatggataatacaaaaagcgagtctgtcattaacgtatttcattttcttcaaagggaattagggacggaagtgttttcccgcctctttcctgtaattcttactgacagaggttctgaattttctaatccatgggctatggaatgcgatgaatatggggaaattctttcaaaggtattttactgcaatgcaaatgcaccttatcaaaaaggaagattagaaaagaatcatgagttcttacgctatatcatgccaaaaggaacttcttttgacgctatgacgcagaaatatataacccttgctgtgaatcacatcaattccacggcaagaggcagtttaaatggcaggacgccatttgaacttgcctccatgctgcttgacgagaagctgttcaaacttcttcgtttggaaccggtagaacctgacaaggttctactcaaacccgcactgcttaaacagcgctaaccatttttgaaacagacatactgcacgacaacggcatactctttcagtcagacaaccggaattcagtttgacagacacccttccggttgtctgttttccatgcagaaaaacagactgtttccctaactatcatacatctttctatcaaaaatgccaaagaaaaagttggctcaaccccgcattttctttggcattctagaatttcatttgtcactggaatttactttggcattcaaccaattttctttgtcctagaattttctttgtaacggttcagcccctctccgtctgtcgggccttcgtttccggcctgggattccttcccctccgctgccggttccgtccatgcagaggatcctgtaaggggcgtataaactcgccggttcttaggctgcatactttgcagccttagcaccgctgcgtgtttatccgagcgagagcaaacgactaaaagtcgttttccctctaagtacctctgcatggacggaaccggcagcggaggggaaggaaccccaggccggaaacgaaggcccgacagacggagaggggatgaactgttacaaagaatcatgctgattctgaaaaaagtcttgcacaaaccttatggaaacggtatattttatttagaagaaccaagtaggaaggagggaagaagatgcacgattatgatgacgcggttgtaatgtgttttcttaagcaccagggtcagctctttcctgaagaagatgtggcttccaatttggaagatgcagaagcttttctggaagagtgtatggcagttgtggtggattccgctgaagaagtcagggattattttgaagaagccggcattgatatggaaggtgctgatttggacgaaattcttgaagcggatgaggtatttgacgtgggtgacggaagatatctgattgtggaaggctgaagcttcgacaggcagacaacaagaggaaagaacatgggcggcaggccggtactgccgcctttaaaacaggtatgtaaaacgggcgtttctatagaagaagcctgttctgtacctgccgcagaacctcacccacctgttccttatccaggctgtaataaatccgttttccctgctgccgtatccggatcagtccttcctggagaagctcgctcatgtggtaggagatggtggctgtggtcagcccgaacctgtccgctatttctttcccataatgcggcgtatcctttatgtaaagaaggatttccattttcgtcccgtcggccagcagctccagcgcatgctgccctaaattccggtaccaggattccagtaccttttcccgcatcaaaaagcctattcgtataaccagcacatcttcctgagactctccgtcgtccatattgaggaccatgaaaggcccgttcaccaggttgggcacaatttccaccgcccggtacaggctttcatccacatatacgcccgtcattccgcagaaatccgtcagactttttttggcaaaataagcctgccattcctgctgaatccgtaacgcctgccgctgcatccgcgtcctgtacgggagcagaagcggcaatgcctcttccagcagcgcccccagctcatcaaggctttcttcataggattcaaacgccaggatcagcctgccctgaaatttttcttccagatccagttttttcacactggcggcgaacctgcgccgttcctcttttttgaggtttaaggtttcaccgatccgatcaaaggccgggaaatcatccagcggatactgccggaactcgttcagcgccagcgccttcatctcttccatactgtctgtctgttcccctccgaaggtccatataaggcacttcgccaggcattccagcccctccttctgaaacggctcaaaatatttccggatagccgaagttaccggaatttcctttgccattgccaggaattctttctgtaaagccagttcttccgtcagctcctgttcaaattttctgagattccacagatatttattttctgaaagctcttctttatttgctgcgagaaacagaagctccattgcttcccggatcatccagcattctttttttatgattaattccatttttcctcatttctgcccgcctttgaatcgtcgggcaacagctcgttcaatttcccggagaccttcagcaccgccataatcaggagaaacaggattcccgatgccgtcaggagagcgggcaccttaaccagcctggccgccgccgatacgagaaaggaggtggccggtaccgccgccaggcaaagggcatttgccagcccggtttccctggacatataatgaatcggtatcgctttcatgatcatgactgccagcgccgtgtttaaaaaaccgatggacacaccgaaaaccaatgatgaaaagcccaggatggggtaaaaaaatatattttgggcaataagcgcacagcctgccaggacaagataaaaacctccattcagtataccacataaaagcagagctttgtcaattgccaccctttttgcaagaaaaggatagagaaacgcgccaagcagcatccctcccgacagggtggcgcccataaaagataaggtctcaccgcccttttgataaatatcctttaccagtgcggactgcagcgcctgcatcggcgtaagcatcgcattcagaaggccgcagagcagaacaagcagcagcagcctccgtgaatctcttaaaaaggagattccttccttcagcgtttttccgtagctttcagcctgctggctcttaagctcttccggcagccccagcggaaggatcaaaagtgccgctatcagaaaacaggacgcatccacgagcaatgcgccataaatccccagccaggcgatcagcacaccggccagcccggttcccgccagctccataatacgcccgcctccctgcagcatggaggtcccgtattcatattcctcttccttcaaaagcctgggcagtaccccgttggtggcagggctgcggaaggcttccagcgtggaaaccgcaaaagtgatgcacagcagcatatacggcgccagcaccttgcccaggtacagagccagaatcagcatgaccagcagaaaacgccccagatccatcagtatcaggacctttttcttgtgcatgcgttccacccatgcgccggcaagcggctgaatcactatggagggtatgtaattgatccccattgccagggctgaaactgcagcagaaccgctgagcagatagataagccagctcatcgtgagtacatccacggaatcccccagcctgttcagcagaaaagaatataaaaatttaccaaaagaggtatttttcctaaaatcagtgaaattcatatcctgtctccttgtatttgaagtatatctaacatatgtttgcctaaagactatcatattataagacaaaagtcaattatatgttagatgaaaatcaaatataaagacgccaatagaaattctgctttatctccctgttatacgcctctgtttttcgatctaaaagcattgaccttcagggaacagagatggtatactgaactcagttatgagatcgtgaaataaagagaaaacaggattgcagctatgccgctatagattacgacattgcccaggcttttaggccgccttccggtcacaggatgacccttaggaggatgtgaaaagaaatcgcaggccttgttttgaaaaaaaggagagattgtttttagatgattcaagggaaaaaacagcagattggatggattaactgcgccaaatttttcgcaattctggcagttctggttgatcatgttaaggggattctgtatgaggatgaaacaatccagtacatattcttctattctgtaaccgtattcattttcctggcgggaatgacggcttattattccctgcagaacaggaaagctgaggagacgggcggaaaatgggtgttcaggaggctggggaggattcttgtcccttatctggcggcggtggctgtttatcagttcgccagaacgggatttcagctgaatctgggggcttatgtgctgtgggcgctgaattttaatctggagggccagttctattatgttctgatctatctccagctgatagccattgctccggtgctttatctgtttgtaatgaactgcaggagaggaaaggccagcttcctgttccgtattgtttttctggtgctggcttggatggcatccagcttcctgatgagacacagctttgccctggaaacctatggcggagggaaatatctgctgggaggcacctatttctttgtttttgcagccgggatgctggcggccgatctgcatatctatttcagggaaaagaggacggcgggaatcgcatctgttggggcaggtctgcttttggcggcgtccatggccttccttctgcatgaccgctttgcatgggacgagtccatgttcggatggctgctgcgggtgaatcctcccggaattaccctgatgctttattcccttgccatcattctcttcttgtttgcgggctgttccttcctgctgctgtggaataaaaaggggataaacaggattttgcagtttattcagtatatagggagatatacgctgtatattttcttataccatactctgatccttgatacgtttctgccggagctgaccttcctggacagccttccgggagccgtgaaaaccttttcgtatatggcggtaatgatccttcttccgatagcgggaaaagagctgtacgatttcctgaaacgcaggatgagggataaagcgggaaaagaggaaagagcgctgaaggagaatttggaatagcagtagcaaaaaacaggaagccgctctcaaggggatgcggcttcctgtttttgttctgttttattggtatcccataaacgcttctgcagaattgtcagcacaggataaatttttcaatggcctgaatcaggccgttatggtcattgtccagagacgtgataaaatcggcagcctcttttacatcaggatccgcgtttgccattgccacgcctgtgcccgcagccagaagcatagagatatcgttgggggcatcaccggcggcaatgctgttttcttcgggaatgccgaatatacggcatacctccaggatagcattcccctttcctgcttcgtggctgtaaaattcaagatactggtcattggaaaactgcgcggtgatttgcccggcgtatttacgctccacctttccctttaaggcctccagcctgtctttatcggtgaggtggatgcaatggaccttatacggcggacggggcagtacagaaaggatgtcggaagccgtgataaggggcatatggattcgttcccggtaatggataacttctttatcttcccgcctgcatacgatttcatgatccgtataggtctgggagtggatctccatttcatcggccatggccatgatatcggcaacgatggggaaggaaacggttttttccataagaggagtacgggcggagcagtcataaatcaggcttccgttattggaaataatcagggttcccggatagaacaggcctgcggcctccatgacctccaggatgctgtccaggggtcggccggaggtgagcaccagcttatgaccggcctctgtcaggcggttcagggtttccttcatgacaggagaaaccgtactgtcacttaacagaagcgttccatccatgtcggtaaataatattttaggcgtatgagtttccttattcatcaaataattccttcctttttaatcgcagtgtctccaggatatcggcggaaatctgaagttttccatagccggtggccatttccagtccgggcttgctctttccgtgaaaatcagaaccgccgctgatcagaagattgtttttttcggccagccgtttcatttccctctcttccctgggcgaataggtggaatatacggcctctatccccacaaggcccgcctttttcagccgggcgaccagggtctgcagggcgtcttttcccatatggtaaagggtaggatgggcgaggatgggaagtcctttcgcgtcgagaatgagatggacagcctgctccggagtaactttttctctggggacaaaatagcggcagcgatctcccacatacctttcgaaagcttccgggaggctttttatatagccatgctccagaagatatctcgcataatgaccgcgggtaatgacagaaccggggaaggcttctttcagcttgtcaaaagaaatatcgattcccgcttcctgaaggttcctgcacattttttcattcctgagaatgcgggaatccacaaaagcctggatctgccggcggaaggacggcattttataatcaatgaacaatccgagaatatggatatcctttcccatatattcggtggaaaattcgatgccgggtatgatttcaagggaattgccggaattatattccattgcttcatcaaggccgtctatcgtgtcatgatctgtgagcgcgaaggcgtccagccccttttctccggccagatcaaccagctgtgacggggaaaggctgccgtcggatttcgtggaatggacatgtaaatctactgtatgcatgctgataacctcatattctgtcaaaaaagggaaagcattccgtacaggacggcagctttcccatcattggattaattttcgtcatcttccttgttggccgtataaaccgtacgttttctggccatggcatcacttgccagatattcatcgtaagtggtgattttatcaatcagcgttccgtccgaaaggatttccataatacggttggccgtagtctgtacaaactgatggtcgcggcaggcgaaaagcgtcacgccgggatacttgataagcccgttgttaagggcggtaatggattccatatccaggtggttcgtgggttcgtccagaatcaggcagttggcgccggaaatcatcattttggaaaggagacagcgcaccttttcaccaccggaaaggatttttaccttcttaacaccgtcttcccctgcaaaaagcatacgtcccaggaaaccgcgcacataagtgatgtcatccacaggagaatatcccatgagccagtcggcgatggtataatcgttgtcaaattccctggagctgtctttggggaagtaagcctgggaagtggtaacgccccatttaaagcttccttcatccggctccagttcacccatcagtatctggaagagggtggttttggcaagctcattgcttcccacaaatgctattttatcattatgccccacaataaaggaaatattgttcagcaccttttctccgttaatggtcttggaaagcccttccacagtaagcacttcattgccgatctccctgtcgggacggaaatcgatataaggatattttctgctggaaggcctgatatcatccagttcgattttttccagggcctttttcctggaggtagcctgcttggatttggaagcgttggcggagaaacgggaaatgaagtcctgcagctccttgatcttttcttccttcttcttattggcttccttcatctgcttgataagcagctggctggactcataccagaaatcatagttaccggcgtaaagctggattttgccgtagtcaatgtccgcgatatgggtgcagaccttgttcaggaaataacggtcatgggaaaccacgataaccgtattgtcaaagttgataaggaattcttccagccatgcgatggcatccagatccaaatggttggtaggctcatccagaagcaggatatcaggattgccgaaaagcgccttggcgaggagaaccttaaccttctggcttccgttcagatccttcatcagggaataatggaattccgtatccacgcccaggccgttcagaaggctggcggcattggattccgcttcccagccgtccatttcggcgaattccccttccagctcgctggcgcgtattccgtcttcgtcgctgaaatcttccttggcgtagatggcatctttttccttcatgatttcataaaggcgggcattgcccatgattacggtatccagtacggtgaaatcatcatatttgaaatgatcctgttccaatacggaaagacgctgtccgggagtgattatgacatcaccgttggtaggctccagcgcaccggaaaggattttcaggaaggtggacttgccggcgccgttggcaccgataaggccgtaacagttgccttccgtaaatttaatattaacatcttcaaaaagcgcctttttcccgagacgcagggttacgttgcttgcactaatcatgtttgatagctcctccataaaacgcggcggtcataactgaaatgaaccgacaatttcttcttatttattcctgcgggcagcgagccggacggacgcgcccaccaggcggctgccgcgagggtaattatgtcatgtatcttgccgcctttacctattttacagaaaaacagggaatttgcaagccattcttgaaaaattctatgtaaaaggtggcagtacagccatatcctgtgccccatgccttccgccggccggggtgtccttttgctgcagttttccttcccgccggttctatgtaccctgcgcaggcacgttttcactctgccaaaaacgcagcggtactaagattgcacaggacgcaatctaaggaccggcgtttttagaaggcctttgcagggtacatagaaccggcgggaaggaaagctgcagcaaaaggacaccccggccggcgaagggcatggggcacaggatatggctgtactgcaattgtaaaaggtctgtaggagaaaaggaatgagagtatgtatgggagagtttggaataatagagcagggaaaaaagtgggaaaataaaatacagagtatatgttgacatacgacatatgtcgtgctacgatatagaaggatgatatatcgaataacgacataacgtagggcgatatactcttcggaaaggagatgagattatggagccaaagagggaaccgctgacagagagttatttttacatactcctgtgtctgtacagtcatgcaaaccatggatacggaataatgcaggaagcgggacggctgtcagggggacgtgtgaagatcggttcagggacgatgtatggtgctgtgagcaatatgataaagaagggctggatcatggagtctgacgaagaatcggaggaactgcagaaccggggacagggagtgaagaaaaagcagtatgttctgacgggtgagggaagaaggattctggaggaagaaatcctgcggcttacggaactgctggaaagtgcggaaaaggtgacaggaagcaggccattgcattaatatttgtatagagagaacgagaaggaaaatcttctgcccgccggatggcaatttttcttcgcgaaacatggaggattaaaggatgaataccaaaatatcatgcaggacatatatggcatgggattatgataaggaagaagagcatctggacgaaatgtccgaaaaaggctggcagctgaaaaagggaggctgttttttcagtgtttataccaggcagccgggtgtggtataccgcaacaggatcgattataatcctgacgcggtcaattctccggaggaaaagagaaggtatctggagctgttcgaagagcagggatgggaatatgtgggaaatacctataacggctggatatattttaagaagaaatatgttccgggaacaccggaagaagaatatgaaatatatacggatgcagaatccctgcaaagccttcttgacagatggaaacgtctgggtattttactgagcgtgcttctgcttgtgcttaccgcaatttatacggtcatggtctttgggggcagatattataatattatattcgtcgcattttatgttgtgctgttggtttggattcaatggggaatgcgccggatgaggaaaaaagttaccggcagcagggcataaagggaggcggatatatgaacgcgggtatatgggagctggatcttcatggaaaaaacgtccttcaggcgaagcaggaggtggacgccgccttgaaaaaggcggacagcagcgtctacaggctgcggataatccatggctttcacggcggcacgggtatccgtagcatgcttcaggaagagtacagctatggaagagagcctaaggtcaaacgcattcagggcggggttaatccgggaattacggagcttgtattaagagattattagtcggagataacatagtttagtaagaggaaagtcctgattattggactctgtatatgctattcttaaaccatcgaagggctcacaggagcctgacaggagaagcgagtaaacggtttaggtttaataatagcagaaaggagccgcggtatgaaaggattttatgttggagaaggatacatgggatgtgtaaacggacagtacatgctttttgcagacgaggctgattatatggattatgtggaggagcaggcgtgagagcctgctcctcttttaaggacggttattctgccaaagaagccaggatgctgttgaatttttcattttcactccactgggggaaatggcaggatttctcaaacaagaagaactgtttgtcggattccagagtatcgcagtactttttaaccagcgctgacgaaacatggctgtcataccgtccctctataaaaataacaggaacgtcatattttctgcagttttcaaaatctgtctgcatcagctcctgccacaggcagcgtattgcctgcaggctgcctttctggcggcggtacaaatcaacaggagtgtagcagcgtgaaaacaaaaagggctttatcagcatgttatagttgctttttccatacagagatcccttatatttgaccacgagtcccgtgacaaagagcagatcatgcagccagtcctccccggtataggaacagtctgtccgtttcagcctttccagctctttcccgacggcatggctgagcgcgaaatcataggcctcccggcaggcttttttcatatggataacctgtccgcagccgatataagtatggattttgtccggatgctgtctgatataggtaagcccgaggacactgccccaggaatggcccacaaggtaaagcttttcctggccgaaccgtttaagcagcaattcggtcagcgtatggagatcctccagaaagtgggctatagtgatgccttccgggccgaatttatagtaggattttcctgcgccccgctgctcccacacgacaaccgtataatgtttttccaaatcccggttatatttcaggaccagaggaagcgcggcatcccccgggcctccgtgcagatagagcagtaagggtgcgttttccttttccgatcggatggatacatattgaagcgctccgttaatggggatggccccttgttcgttaatgtacatatttcctcccggcctgccggctgttatcggtttttacgcctgatagctgccttatgacaggctgtttttgtttcctctattgtaaggtctgcccgaggctgtgtcaattgtattgcaggagtgttctgcaattttccatttgctgcagttcattccaaaatattcccggaactggacaaaaggcaggaaaaaaagtataataatttcatccgcagtattgcggctgattggctttatcaagccattttcaacgaaaattcagaaggcaggaaggataaggggtatggcatacggttcgattccattggaaaaaaggttgagggaaaatattaaaagctacaagctggaaaacctgtatgatttagagaaggtacagaaattattccgggatcttggagaggcattcggcatggagctgcttttaacgcagagacatggggaaacagcggttgctgtcggggatttttcggactttgagccggatgtggagacggagcccggacgtaagatcagggtggcggaaaggacgataggacatctttatgtgaaattgagcagtccggaggccggacagaagattgaggctgtcctggatgatctggctgagctgtattctttcctgggagaaaagcagtaccggttccgggaaacagcgatatatgcggatgaactggaggaaaccctggaaaaggacagatatcaggcgaagcacggagaacatgtggacgcgctcacaggcctgctgaacaagacttattttgacggaaggcttaagcttctcaaggaaaccggtacggcgccggatgctttgatttgtgtgaatatcaatgactggaagttcgtgaacagtaattacggtgatgaggaaagcgaccggctcatcaagacggttgccgatatcctgaaaagggaagcgaagccggactatctcataggccgtgtggacggggatgtcttctacattgtaatagaagtgccggaggatggagaagccctggattactgcaggcgcatcaaggaggcctgcctggcgttcgaggactccctgctggcaccgtcagtagctatcggtatggtaacaaggctgagcgtggaagaggattttgcggaaggcttttccgaagcggagtacgagatgttccgggataaattcgatgagaaaaacagtcccggctatcgggagcgcctggaaaaagggcttgcaaaatagaaaaatggaataaaaggatgtatttaaaactccttttcgttgggaatagcagggaagccattcttaacggaaaggagtttttttatgaagatccgaattccgtacaaaaaggaacttctcattatatttccgatttgttataatatccaatatcaggtaaaaaggtccggggaaaatggtgaaagtatacaaagaaaagagggcatatgtacagggtattatttgcagaggatgaattgctggtacgtcttggcttgaaaaatgccatcaggtggtccgattatgatatggaagtggttggggaagcggataacgggatcacggctttggagctgtttgaggagctgaggccggacgtgctgattacggacattaaaatgggcgggatggatggctatgagctgataaaaagggtcagggatatagacgggagctgtgccgttgtgatcatttcctgtctggatgattttgagaccctgcgcaggatgatgggctactgtatcatcggctacatattgaaggccagcatgacgcttgaggaaataggggacgtgctgaaccgtaccaggcagtatcttgtaaatgtacgcaggcagcagaatgtacaggaagaaaataaagaggaaaaaagagaaaatgcgttgagaaattatctctgcagcgttaccgggccggaggaaaacatccgctggatgtcggactgggggctccctctggaaaatctccgcacgctgattatcctctctctgcgggaggcggatgagaagaaaatcaatgagcttggcatgaagctggtccgccagcttttgtgccagagctttcctgaggcggtttgtgtgcagacaggcagtacggagctgacggtgatttgtaccgtggaaggagaggctgcagaggaacagctgctgaaatttgataatgccgtcaataatctcctggacgtgaccttcggaaaaaagaagatgcgcctttcccgggaacattccgtttgggaatcctaccaggcgctcaggcaggaaaaggaagcggtctgggaggaggatcccctgatggaaaaggccgtccggtttatggaagacaatcacggaaagcagatcacccttcaggaaattacggattacctctgtatcagcaccagttatttttcttcgcagtttaagaaaaatacagggaaaagcttcgtggaatacctcaatgacatccgcctggaaaaggtgcttggcgagctcaggtattcccgggaaaaaatagcctatatcgcagagaggcacggcttccggaaccaggagtattttacccgtttctttaagaaaaagatgggaatttcaccggtgaaatggagacagcagcacttcggaaaggatggtggttcccggatatgaaacggcttaactggaaaataaagctggtcatcactatcataagcgccatcagtctggtagtggtgattctatacatggtaacctatttgttcttttcctcccaacttcgcaggaatgatgaaaagatcgcccagatcaatttcagacaggcagaggaaaatctggaacagattattaaactgggtatccgggatgccaaccgttatgacatggacatgctggcgtggaacttcgggaacggggaatatgccgatgatgccggcagaacggcgctcaaccggaaaatgatcctccggtttgaggaaatactcgctatcaatcccaatctcagcgctgtggcccagatgaacgggaacggacagacggtcatatccaccgtaaataagaaccggagcggaatgactgtggttcccgatgaattccgggaaatcctgcaggaaagcacgcagtcctatccggctttccaatgggtgcctgggaatgtcctgggagacagggaaattctgtgcaaggcggcggaggaaccggctgtcctgggaatccgctccataggcaagtccgaccgggcggaggaggacagttatattattctcggcatttcagaagaaaggatacgaagatgctatgaatccgtggtttacaacggaagctccgcaatgcttctggatgagcagggacagattatttccagcacacgggaaggacagctgtaccgtacctttgaaccggaaaaggactgccagattgtggtttacccgctgtcctacaataactggacgctggtgaatatgattccggtcaaaaattaccagaaggatatccgtaccttccgtaatttttccctggcgattatacttactgccgcgctgtgcgtcatttttattgcggtgatatggagcaaacgctatacggctcctatccagagtctgatggacaatatggaaaaggtggggaaggagcagcttgatattgccctgccggagaaaaccggcctttcggaacttgataatctcaatgaagaattctgccaaacggtccggaggctgaagcgctatatttccgaccttcagcaggcggaaaaggataaagccgcggaagaactgaaggccctgcagtaccaaatcaatcctcatttcctgtataattccctcaattccatccgttggatggctatgatgaccaataacgggaaaatagcggattccatcgtcatgcttaccaaaatcatcacgcctgttttcagaaatcccagcctgacatggaaaatcagggatgaactggaattcctggataattatatagggatgatgatgctgcgttatgcggggaacctgcaataccggatggagtgcggcgaggatctgtacgatgaggtctttccccggtttgtgcttcagccgatgattgaaaactgcttcgtccattgccgtaccaaaacggacggtatggaaatcagggtgaagatccggaaggaggaaggcagttttcggatagaggtgaggaatactgcggagcaggtagatgaagaacgccttgcgcaggtcaatgaacagctgaggtcccggaggaaatcgggaaaagaggatgtgggcctgataaatgtggtgaagaggctgtcttatctttatggggagaacagcagcgtcaagctccgggcggagggaaaggaagtcgtcggcgaaattatattctctgtataaatatacaaaaaaaagaatataggtcagaaaaaatgagacaaaatgataaggcagatgaaatctgacaaatgaaaagtaaaataagacagataaaaatccccgatatttgatagagtttatacacaggaagcacaagacgtcttatgtacaactgtatcaaactatattggaaggggatgtactatgaaaaagaaaaagataacagcattgatttgtacggcggcactgatggccggctgtctggccggctgcggcaaaggggacggaggaaatgccgtacaggcggatgccgataaaggtacggcggccggtacgcaggacagcgtctcagacgagggtgcggcaggggatatttccgagcatgttaatatttcaatcggcggaatcaatgtggggaattccagttcctccgacggatggcctacagaaattgttacttatatagaagataagttcaatgtgacgctggaaaccaaatcctatgataacgaaagccttaatctggatctgtcaggaggtaccacctgtgacatcctgcagattaatgatgaacatattgaatccatattaaagggcaggcatgcggtggatctttcccagtaccaggacagcctggccgcgaatattttttcggacacctattccctgcggaatgaggttttaaaaagctttaaaagcaacggggaagataaactatattttgtgactccccgcgtgacttcggaaaacgcccgttccacctacggcgccacattgaactatggctatgtggttcgctgggatctatacaaagagatcggctgccccgaaataaaaaatgacgacgactatgtggatgcgctagtcaggatgaaagagatttatccggaaacggaagacgggcttcctgtatacgctctgagcgcatacaacgacagcaacctgcatccgtatttcttcatcggctgtctgacacagggctattccaacatggaaagcggactgtatgtgaagaacatggcaacgaatgaactcattccggatatttatgacgagaacctggatgggattacaacgcctttctgggcaggcatgtctttctataataagctttataatgccaatcttctggatccggactgctttatcaccaaaggagaagacctgacggaaaaatatacgaaaggacagtatctgggcggctatgtaaactggcacttcggtaattacaataagaatgccagggctgcggatccggagacggagaagcagtatgtaatccttcccacctatatgggatgggcaaatgaaagaaattatgccggatggcagggcaaatatttcctggtatcctcccacagcaaaaatgtggaaagagcggttatgattctcgactttttacagagtgaggaatgctccagaatcgttgactgcggtattgacggaagatgggaaaccgcggcggacggaaccccgtccctgacagaggatacgattgacatgaaatcaaatccggcccgcgccgaagaatggacgaagagcggaatcggctctacgttttccgatatggtgggctatgactccaataatatcgcttccgacggcggcgccataagcctttgggaacagcaggatattatggtaagaaacctgacggcggcggaaaaggatatgtgtgccgcatttgacatagaactgccttccgatttgctgaagaaaaaggtggaggcaggagaaagcatggatttgcgcgcaggcaattctgctatccagttcggtatggaaattgtgccgagtgatatcggcaggatcgacagcaactgtgaacagatcacaattaatgccattcccgggcttgtccaggcaaaaacggaggaagagttcctggcggcgaaggaagcgctgatggccgaactgaaggcggcaggcgcggaggactccatcgcatggtggacacaggcctggaatacggcgaaggaagcggttgaaaaaatgcagtaattgtacttttgcggcggacagggatcctgtctgccgcagtccggtaaagacggaatcaggaggtttgtaatgaaaaaaaagactgtgataccggggcggaggaaaaagtataacctgctttttatgaccctgccttttatggtaatcgttcttctttttaactatgttccaatatttggctggatttattcagtctttgattacataccgggtatatccatcctggaatgtgattttgtggggctggattatttccggctgattttccgggatgccaatgtggtgagaaccttgaaaaatacatttatttttgctttaatcggcatcgttctcaccccgcttcccatgcttttcgccatcctgctcaatgagatcaaatgcagccctgtccgcagagtggtccagacttttaccaccctgccaaactttatcagctgggttatcattttttccctcgctttttccctgtttgcgaccgacggcgtggtgacctccctcatagcggggattacaggaaaagaagtgacttctatattaagctccggagaatcggtttactggtttcagacgcttttgggcatctggaagtccctgggctggagttccatcatttacctggcggccattgcgggcatcgatcaggaacaatatgaggcagccagagtggatggggccggttattttcagtgcgccgtccatgtcacgatcccggctctcatggaaacctatgtggtgctttttatcctgcagatcggcaatttcctcaataccggctatgaacagtacatgctgtttaaaaatgcgctgacggccaacaacattgaggtgctggatctgtacacctaccgtatcggtttggagaacatggattattcctacggagtggctatcagcatcctgaaatccctggtcagtatatccctggtggttctggcgaatatggtagccaaaaagatccggggaaatacggtaatttgacaattgtgcaggcgcctgaatacgggaggatgtaaggaaagatgaaaataaaaccgtctaaatcaagaattgcttttcagatatttaattataccctgatgctgctggctacatttgtatgtgtctaccctttctggtatatcgtcatttataccttcagtgatgccgcgaaggcagggataaacaatccgatatttctgcccaggggattttcggtatccaactacgtggatatattcaagctgagcggcttttttcccgcactggggatttcagtgctccgtacagtggtgggaaccgtggctgccgtactggtatgctccttcctgggttatatgtttacgaaagaagagatgcccggcagaaagtttatgtaccgctttctggtaatgaccatgtatatcaacggggggctcatttccacctttattgtcatgaaatcctacgggcttttgaataccttctggatttatatcctgcccatgatgatttccgcttacaatattgtactgataaagacctacatggaatcgctcccggcctccctggaggaatccgccatgctggacggagccgggtatatcaaggtgttcaccagcattattctgccgctgtcaaaacccattattgcgaccgttgcggtatttgtggctgtgggacactggaattcctggttcgataatcatatttatacgagaggggaaagttcattgacaacgctgcagtatcttttgtacaattatctgaacgagtcgcagagacttgcggagcagataaaaaacacaagcaatctgagcagtattgaaaatgccatgggaacgatatcccccaagggcgtgagaatgactattaccgtactggcatccctgccgatatttatggtatatccgtttatgcagaaatattttgttaaagggattatgatcggtgcggtgaagggctaaacggggagcagaaaaatccgaagcggtgaagggctaaacggggagcagaaaaatccgaagcggtgaagggttaagcggggagcacaaaacctggagcggtaaggacaggaaatatgcgcagtaattactgaaaaacaaaaaaactatgcgggaggaaaagaaaatgcaatcggaagaacgataccccggattccgggaggatgagagactggtcggcgtggtgccctcacccaggcagatcgcccatcagaaaatggaatatttcggctttatccatttcacggtcaatacctttaccggaagagaatggggaaacggggaggaatccccttccatttttaatccggaaaagctggatgcaggacagtgggccgagactgcggtcaggggaggcatgacagggctgattcttacctgcaagcaccacgacggtttttgcctgtggcccagcgcatataccgaacacagcgtcaaaaattcgccttataaagggggaaaaggtgatatcgtaggagaacttgccgaggcctgccgggaaaaggggctgaaattcggagtttatttatctccatgggacagaaacaatgcggcttatggatcggggaagccttatgacgactactatgtgaatcaactcacggagcttctcacaaattacggagaaatcttcaccgtctggctggacggcgcctgcggagaagggcagaacgggaaaaagcaggtatatgactgggaacgctattatgaagtagtcagacgtctgcagccggaagccaatattttcggatgcgggccggatgtgagatggtgcggcaatgaggcaggagataccaggccgagcgaatggagcgtggtggcggcggaactggcggacgcagaaaaagtggcggccctcagccagcaggaggacaatgcacagttccgggagaaaaagcttacaagtaccgatatgaatctgggcagcagggatgttttgaaggataaggcagatctgatctggtttcccgccgaggtagacgtatccatccgcccgggctggttttatcatgaagaagaaaacgataaggtgcgctcttttgaaaatctgaaagagatctacctgaaatccgtgggcggaaactgtacgctgcttttgaatatccctccggataaggatggattgatccgggaagaagacagaaaaagcctgttccggctgggagatttcatcagggaagccttccgcgtgaatcaggcggaagaagcgaaaatagaaacgattccctctgcagactgcgaaggaaatgaaggaagtgtccttcttgaaccaggtgatgattcctggttccgcaacccggacgggcagcgggagcttcagataaccttgctttgggaaaaggaacgcacgctcgattatctggtggtacaggaagcgattgccttcagccagcgtgtggaacagtttgaagtcagctttatggatgaagacggcagctggaaactgtttgcagaagggactacagtcggctataaacggattgttccgttaaatgggctgcatacgaaggggctccggtttaaggttacggacgcaagagttgcgcctgtgctggcgtttgtcggagtgtattgaaggtctgcagacagagactgtcccgttaaaaacagatgaacggtaaattaataaaagaaagtcaaataagcgccgcagtcctttttgggattgcggcgtttattcattccctgtaaatcaatttatataaggtatttctcagacagtgacttatttgacgcggaacggaaacaggaaaacagaataaagatagggggattggagcaaatataagcttttatataataaagcggaaagtgttgtcgaaatactacaagaattgtatctattttgttatatgatttctattgctataaatacggaataccgcaaattgacgttgtgctgaattaaaaaaattgatataatataattgtaaaaaacaggaggtgatgataaaaggataaaatatgtggtgtgcaacctgatttttgtcaaggaaggagccgaggatgaaaaagaaattttctattattttatgtattgctttaatttctggtttgtcaataacagtaaatgctgccggtaagggacttgttaatgaaaaaacatattatgtagtaacagatatgaatgaattaatgtggttgggagccgaacaattagtaagcagatcatctatttatggaacagagaatgaaaataaaaagtctatgacagtaatacaaactgtaaaagaaagaagttatcagaatggaactgttgaaacagaagttatgatgcatgagattgcttataaagataaaaatgggaaattgcttacagcatatgagattgccagagagataggatatataagcggtagtaaacccactactccgattacagaatatggtgtaacacttgtaaatactatatatgccacattgcggcttgatcccacatcagcgttaattcctgcatatagatgtgatagagttacaacaacaataatagttcctccttcaggagtattgccgacaacaggttcaacctattataagcattaccatgctaatgaagaaaaggaacaatattttactgcaaatttatctcctggtcagcaggtgtttacgttatatcctgataatccccaatttgcacaatcagcttcgatacctttgtattatggactccatgcacagtctaaggttagtttggcgaatggtcatactatgatagtacaaaatggaatttcacaggaagagccttggtaattataatgaatagattacataagaaggaaattttaagcctgattatttgtcttttggggagtactatattttgtgcatgtaatagaacaaaagagattagtcataatgtaagctctaagttatttggtgcacaggtttctgaggctggcgaattactgggaataaaaatcgatcctgataaattcacagaaaaagagatgggaggctgtgaatttcatgtttatactgctgagggttacacattctgtggttacaaagctacagcagatttgtatttttggcagcaggaaattgctgacggacagcaattaggattatctgttttgcaaatttcttttgtggatttgattgatttagacgtattggaggcctgtttggcagagaattatgaacctgcgcataaatcaaaaagcagtacggaaatagcctggcagggccaggcatatactgaacttgagcaagccggcaaattagaaaaggtatttactgatctaatgggcagtaaaccattaatgccgttatggattttacaaattcgtcagacaaagaaagaatatacggaattaaccttgatttgccccgcagcagcagtttatcgccatatagattcttttgaggattaacagacctgaaaaggccattgccaatctgagcagtcagatattggtaatggccctttgtatgcatttttgctgagtgcggcagcggcctgcatcccgataatgttggaagtacaggctacccggatatccggatataagggatggtaatatcaataatagtcccttctccgggcatgctttctatacaaaagccaacccctttcccataatggctcagcagccgctggtggatattccggaggcctatggaatgatgtttgtgctccggactccgggaagccgaaggagcagtgcgtggcagcgttccttccgacagttcctttctgatatccgccagaacattttcaggaataccgcaaccgttgtctgcgaccagcagatgaaggcctgagtcgtccagattgcagctgatgctgatataacagttgctttccatacaggaaaagccgtgttcaatactgttttcaacgagaggctgcaggataaaggccgggatctgcagattcataaattcgccgggaatattacagtcgaatataaatttccccggaaaacgaatattctgtatggtcagatatctgttcacctgctgcagttcttcctccaaatgtgcgattgggaatttttccagattataacggagcagatccgacatgcagacggcgattttctcaatctcggggatattatggatatcagcgagcgactttataacattcagggtattgtagaggaaatgatgattgatctgaaactgaagcatctgattcctcattttctgttcgtcgagctgaatctgatagttttgctgaaggctgctcacaaggcgctgattgagctggttaaagctggagaccagtttgcgcagttctttgttggaaccgcagaccgacagatcgatggttcctttaccctggtccggaacgggtactgctttggacgcatttagtttcggggagcttagttccatagaatttagttccatggagtttaattccatagaatcgatttccatacataaacgggaaatggaattggtcagcttacccgaaatcaggacagcgagtatcagccccaggataaggctgagtataaaaataccggaatggctgaagaaatttttccggtaaacctgagtaagaagctgattatctgcaaactgcagcaaataccacttggttgtctggttaatgcatccatttatcaagtacgttgtatttcccagagtgatttttctggtgacaatggaaccatcggagggaaggctccgggtaaagtcggtaagcgtatgtaaaagttctgtgttttctgccgaagcggaataaaggccttcatcggtcgaaaacgtcagctggttcatcgtattatagatcatcagtgtattttccgaggtatgggcggacagcagtattttttcaacaggtttgaaatcgaattcggcataacagactccgatttccttaaaatcgtaaccgtcataaagtattttaatcatgggaaggacgcttttggaagagcttgcataggaagaacgctgcagaggggcgtaataggtatgattcggggactcggcggcaagcgtatgcgtttggtttatggtttccataatctgcttctgctggctggcattgatgatattgtaatcaaaaacatagccgtaacggttttcaaatacacaggtgacaagattgctgttcagccggttcgtttgtttgaaaaggtagcggaacatggtggaatcctgggcataggacagatagtcggactgataattagtgaccatagcccttcttatatcatcgctcagaagcggcatatccgcgatcttggcagcatcctccagaagcatatcaagagtgaggctggcttgggataatatagtaatcatggaattactgtactccgcagcgatctcagaggcattttttgtcgcggcagaaatgctgagcaaggtggtgggaatgattatgagcagtaatgagtacaggaatatctgaacccggtaggataagttcgccgtataatggtgcattaattagtttctcccttctgctgatttgttttacaagtatagcatatcctggttatccaaaatataagatcccttcaaacatttcctgatcccctcggtaaatttccatatttatcctaagataaattctatttttttgtctgttattttcttataatcaaaacagtttcagaaaaggaggagacacaaagatatgaataaagcggaaagagtcattgcggtaatgaaaggtgaaaaagtggattatgtcccggcgggtttctggtttcattacaaaccggaatataccgtggaagagatggttgatgcacatatgaagctttatcgcgaaacagggatggacatcattaaaatcatgcaggattatatgtatccgatcgtcggggagataagaaataaagaagactggtatgaggtaagcgttaaggatacttcatcggaggaattctgcaagcttgcggccgtgattaagggaatcagaaaacaggcaggagatgatgtccttttgttccagaccatgttcggcccgtttaaagcggcatccattgcttttggagatgaagttctcatgcgttacagtagggaagcgccggaggccgtggaagcgggaattaagaggattgcggacggcctgcagaaatgggcggaaggatttctggacgcgggagcggacggaatctattattcggcacagttcggtgaagaaggcagattctccaaagacgagtgggaacggctggtaaagccttttgatcttcagattcttcaggtggcgcaggaaagagaaaacaagtataacattctccatatctgcggagagccggaatatgaattccgtacgcatccggaatggtttgcggattatccgggagatttggtgaactggtcggtaaaggacaatcatttaagcctgacggacggaaaagccatattcaacgcaaagttactgggcggcatggataacaaaggaaacatcctgagagggccggcggaaaatatcaggaaagaagtagaggggatcctggatgaattcgggacaacagggattatgattggggcggactgcacgattcagggaaaggatatccgtcttgattatataaaagaggccgtggatacggcacacaattatccaataagggaggatcagaaatgagaaaaaaatgggcattggtattatgcgccgcattgacggcaatgagtttagccggctgcggcggcaagaccggagagacgaacgctcctgcggcggaatcatcagcaggaaaaacagaaagtactccggaaggaacccaggaagcgcaggctccatcgggagatgtaatgacaattgaattcttccagcagaagggagaagagggaccgcagaagggatatcaggcaatcattgataaattcaacgcggccaatccggatatcaagatcgaaatgaatacggttccggatgcggggactgttttgacttcccggatttcatccggcgatattcccgtcattttttccgactatcctacacagcagcagttcagacagaaggtggcaaatggatacgtacaggatttgtcaggacaggacttcctgaaaaacgtaaatgaatcttccctggaaatgacaaaacaggaagacggcggttattacgcgctgccatacagccgtaactatatgggcgtcttctataacatggatattttcgaagagaataacctggaaattcccgagacatgggatgattttgttaagctttgcgataccgtgaaggcggcagggatcactcccgtcggtttattcggaaaggatccgggaagagtgggacataccttccaatgcacgaccgtggcatgggctccaaacggtgtggagacaatcggaaaggcggcgcagggagaagcaaagctggaaggcgatcctgaattcgtgagtgcctttgataaaatgtcggttctgctttcttacgcgaatgaagacgcgctcgccctgtcagacacagcctgctgggaaaagtttgtaaacggtgaatatgccatgtgtgttaccggctcctatgcgagagggacattacaggcaagtaatccggatatcagattaggagtatttccgcttcctaatgacacaaaggaaaccacccatgttttatcagggattgatgcggcagtctgtgtgtccgcaaaagcaagtgatgaagagaaagcggcagcatataaattccttgcatttctggcggatccggaaaacgcccagctgttctgcaacagtgacggcgctccttcctgtatcaacggtgtggaaaatgacgatgaagggatttcacccatgaccgatatgatcaatgccggtcagactcatgactggatggcttctacaatcaacaataatgttattacggacttgtataatgtggttcagggtttctgggctgacaaagatgtggacgccgttcttaaaaatatggacgcttccatagccgttacatcagcagaatagcagagggactcaatatggcggaggtcttcacagcttccgccatttttaaaatttccggaaagggctgagtaagtaaaaaatgtataaaaagaagaaatcatccggattatccggaaaatatatttatttcggattcacaattattccggttctgctgtattcgtttttctatgtggtttcggtgataaatggcgttcgatacagctttacggactgggacggaatgtcacaggagttccattttgtaggattcaagaattatgcgtctctgctgagaaatccgaatttctggaattccatgaagacgacggtatactacagcatcctgcttgtgacaggggttatccttacgtcgcttgcgctggccatttcgctgaattccctgaagcgcttcaaaacctttacgaaatctatttttttcattccggccatgatcggcggagtgaccatcgctcttatctgggatcagctttattacagagtggttcctgttatcgggcagctgctcggaatcaaatggatgtcgcagagccttctgatgacgggtaaaacggctttgccggcggtggttttcgtacagatctggcaggcggttgcgctgcctaccgtgatttttattgccggacttcagcagataccggaggaacagttcgaatccgccaaaatagacggggcgacggcttttcagcggttccgttacataacgatgccgtttctgctgcctacggttacggttaatctggtgcttacgatcaaacagggcttcacttcctttgatttcccgtttgcgcttacgggaggaggaccggtacgttccaccgaggtaattggaattttgatttataatgatgcttttaagaacctgagattttcagttgccaatgcagaggcatgcttactgtttcttgttgtggctgttttttcactgacacagctgaagcttaccagcagaggaggtggggactgatgggaaagataaaagaagccctgggatggaaaatattacgtgatatcctgctggcatgcggacttgtattgattttattccctttatatcttgtactgattaattccttcaagacactggacgaagcgggaaagaatttctttgcccttccctccggaattaatttcgggaatttcatagagttatttaccaacagcaattactggatattcctgaagaattccttcaaaatatccgttgtatcggtactgctgatactgacttttgtcccttccgtttccttttcaattgccaggaattttgagaggagatattataagaccatatattattacctcctgatgggattattcattccgtcacaggtgattatgcttccggtaacgaaaatgatgacaaagctgaatatgctgaatcatacgggcttaattattctgtattcggcattcagcctgacacagggggtattcctttttgtaaattatatcagagggcttccctatgaaatcgaagagtctgcatatattgacggctgcagtgtttttcagacttatgtcaaaattgtgctgccgctggtaaagccgatgatagccacacttctgattatggatgcactgtggatatggaatgacttcatgcttccgctgatgattctgaaccgttcacagaatatatggacgcttcccctgtttcaatataatttcaagacggagtattcttttaactatacgatggcgttcacggcatacctgctgtccatgctgcccatgctgattatttactgcctgggacagaagtatattatcaaaggactgacggcaggcagtgtgaagggctgattattctaaaagggggatttcggttgattacaatactggtggttgaagatgagaagtatgctctggattcgctgctcaaacaaatccgggaatatgataagcaggaaagcttccgggttctgcaggcgtcaaacggaaaagaggcgtaccaattatatatacagtattcgccggaattggtgatgaccgacatccgcatgcccggaatggacgggctggagctgctgaaagcgatacgtgagaaagatgagaatacacaggtggtaatcctcagtgcatattcggattttgaatatgcacgggaggctttgacatacggcgcatccgattatctgctgaagccaatcaaggcggagaatctgggaagctgccttgataagttcctgaaacgtaaggtgacggagaaaaaagaagcgctgatgaccgggcgggatatggtgacacaatatattgctgactgcatcagaagagaagatttttccaattttctggaagaaagaatgtttaagaagatattccgggattatcagatatcggttatctattttgcgggggaatgccggcctgacaagggcagattcctgacggaaatagaaaagctgtacggaggggagttctggatggaattccggttcctggagacggaaaatgatctgtggacgctggttgtcaatctgtgtcatgaaaacagtttttttcaccgaaggatactccggcttctgcaggaggaaggctatgacgtatatatcggagtgagcgctctgcatacggatgccaaagaggtacatcaggcatatgacgaggctttaaagacctgcaaatacaaggtatacggcaaagaaaggctgctgctctccgatcagcctgcagaagaaggggaatacagatactatcttcccaaaaaagaagaggatctgctgaaagaggctttgaaatgcaggaatacaagaaaaacggaaatggtcattgagaatgtttttgcagatatcaaaaaaaccggaagtatcagtatggaatgcctggaactgcttctgtcgcagtttctggtcatatacaggcagacactcggggaaggcggagtgaataaggaggggatgaccaaaggccgtacctcagtccttcagtttgacagtattgaggatatgcgggacttcctgatccgcatcggcaggaatatatgcacgatgctggaagcaccggagaacgggaaacataaggacatcgtggagacaatggcggaatatgcgcagcagcattttgaccaggaagtaacggtgaaggaactggcggagaaggttttgtttatgaaccaggattatctgagccatttgtttgtggaaaaaaaaggaatcagctattcctgctatctcagacaaatcaggatgcggaatgcggggaagcttttggaaaacagaaagctgtccattacggaagtggcgtctatgtccggttacaacgatacctcccagtttataagagtatttaaaaaggattatggaatgaccccgaaaaaataccgggattccatgaaatggaaaaacagctccggagaacagcaaagcacaacggagtgtgaaggagggggatgcgcgtgaaaaataccctggatgagtggattgcactgcatgaacaggagtttattcaagatataacggctctggttgaaatacccagcgtatcggtcaaaggcggcagtacgccgtgcggagaggaatgctttcgggcattggagaaaatgctggagctgggaaagaattatggattggaaacagaaatgatcggcggccgctgcggacggatcagtctgggggaagcggaaagagaaattgggatctggaaccatctggatattgtgcccgcaggagagggctggacatatccgccctttgcctgtcaaagacagggcgattttctgattggacgcggcacgcaggataacaagggaccggctgtcgcagtcttatatgcactccgttatctgaaggagcaggggatgccggcaaaagtacggttcagccagatactcggctgcgaagaggaatgcggaatggaggatgccggctggtatgtaacacagcgcagagctccggactggtcctttgtggcagactgcggctttccggtatgctgcggggaaaaaggcatctgccggattgccctcaggtcggaaaaaataatggagagaataaaggacatatccggaggaacggcagtgaacagtgtgcccgcccatgcggcggcagtgctggagcatgacggtgagcttgtatcgatagaagcggaaggaatcagcggacatgcagcctttccggaagggacggaaaatgccgttaagttattggcagaacagctgatgacatatcctttgggagagaaagaatataaaatggcggagttcctgggaaaaatatgtacggacggatatggcatcgggctggggatagcctgtgaagactcgctgtccggcagacttacctgtaactgcggcctgatccgcagccgggaaggggcggtaatcttccagctggatattcggtatccggtgacattttccggcgctcagattatagaaaaagtccgtacggcagcagaagaaggaggcttcaggataacagaaacagaggatgatccccctttttatctggaacccggccttccttttattcagattttaatggaagcatatcaggaagagacaaaagagcggaagcttccatacgtaatgggcggcggaacctatgccaggaggattccccatgcggttgcatttggcccgggaatgagcgcagatatgcgggaactgaagctcccggcaggacatggcgggtgccacagcgccgatgaagcgcagtcgattgctaatttgcagaaagcgatacgtatctatgttcaggtaattgaaaaattgaatttatggatgacaggagagacaaataaatgaaaaaaataaatatcggtaacggaaaaatagaagcaccggaaatcggtctgggatgtatgaggattacggggctggataatgagaaggaaatcagggccctgatcgatacggccatggaagagggcatctatttctttgaccatgcggatatttatgcgggcggtcaggccgaagctgcattcggcgaagccataaccccgtctttacgggagaagatgatacttcagaccaaatgtgccatacatccgggtacctgctatgatttttccaaagaacatatcctccggtcggcggatgaaagcctgaaaaggcttaaaacggattatattgatatcctgctccttcacaggccggatacgctgatggaaccggaagaggtggcagaagcattcgaaactttggagaaagcggggaaagtgaaatacttcggcgtaagcaaccagaattccatgcagatggaactgctgaaccaatactgcggcggccgtatcatgattgaccagctccagctgagtatcgcccactgtgatatcatggattccggaatcaatgtgaatattcataacgaagccggcgccaacagggatggaagcgttctggagtattgccggttaaagggtatcaccatacaggcatggtcacctttccagtacgggatgtttgagggcgtgtttataggaagtgagaaataccctgaactgaaccgtgtcatggaacgtatggcagagaaatataatgtgaccccaaatgcaatagcaatagcctggatactgagacatacggcgcatattcaggctattgtgggaacgacaaacagacagcgtctcaaagatatctgtaaagcgtcggatgtctgtctgacaagggaagagtggtatgaattatatctggctgcaggaaaactccttccgtagacagggaagacaatcagcagataaaaaggaagacagggaagacggaatgaatgataagatttatgggaattatctggaaatcctgcgggaagagcttgttccggctttgggatgcacagaaccaatcgcccttgcctttgcggcggcaaaagcgagagaagtgctgggcgaatttccggaacaaatggcgatccattgcagcgggaatattattaaaaatgtaaaaagcgtaacagtccctaaatccggaggaatgcacggcatagaagcggcagccctgcttgggctgatcggaggagatgcaggcagggaacttgaggtactggaaaaggtaacggatgaggatattgcaaaagcgaaggaactccttgaaaaaggattctgcacctgccttttggaggaaggggtggaaaagctttatatccgggtgaacctgaccggacacacacatgaagcggaagtggttattgccgataagcatacaaggattgtccatatagaaaaggataaaaaagttctgttccatctggatacggaggaaaaagaacagagcggacatgcggataagagtctcttgaatgtcagggatattctggactttgcacagcaggtgaagctggaggatatccggtatattatcgggagacagattgagatgaataccgccatatctgaagaagggcttaaaaatcattacggcgccgaggtcgggagaacgctgctgaagaattacgggaatgacgtaaaggtcagggcgcgcgccagggcggccgccggatccgatgccagaatgaatggctgttccctgcccgttgtcatcaactccggaagcgggaaccagggaatgacctgttcccttccggttatagaatttgcaaaggaatggaaaattcccgaagaaaaaatgtaccgcgcccttgtggtcagcaatctgacagccattcatcaaaaaaaatatataggcagcctgtccgcctattgcggggcggtgagcgccgcctgcggggcaggagcggctatcacctatctatacggaggcggctacgaagaaatatcacgcactatagtcaatacaatcgctaatataggcggtatgatctgcgacggcgccaaatcctcctgcgccgctaaaatcgcctctgcggtggattcggcaatcatggcccattttctggaaaacgaggatcacggatttcttcccggagaagggctggtacagcctgatgtggaaggaacaatacgcagcctgggctatgtgggcagagagggcatgaaggaaacggatgtgacaatattgaacatcatgatcgaacagactaaaataccgtaaccggaaaatttgactttctttccattttttgaggaataaggaaatacataactggaaatgatgagttgctttttcagcgaattataaatggaaaaaacctgaatttgtttataatttatttataaaaaaacactgaaattaagaaaatggaagaaaacaagagataaaaagagatattatgagcaaaaaacaaatttagtcttgtgaagggcgttgcataaaataacccaaaaacataatatatgtatagtgtttagcactcaataaagatgagtgctaacaacaaaaaataccggtgtaagaaagaattcattaaggaggcatttttatgaaattagtacctttaggtgacagaatcgttttaaaacagttagaagcggaagagactacaaaatccggaatcgttcttcccggacagaacaaggagaaaccccagcaggcagaagttattgcagtaggccctggcggaatggttgacggcaaagaaattaaaatggaagtaaaggccggagataaggttatttattccaaatatgccggaacagaagtgaagctggatgatgatcaggaattcatcattgttaagcagtctgatatccttgcagtaatcgaataagaaaaagaaaactaaacttataatcaggaggcgtttaaatcatggcaaaagaaattaaatacggtgcagaggcccgtgcggctctggaatccggagtagatcagttagcagataccgtcagagtaacccttgggccgaaaggaagaaacgtagtacttgacaaatcctacggcgcaccccttatcaccaacgacggtgtaaccattgcaaaggaaatcgaactggaagatccctttgaaaatatgggcgcacagctggttaaggaagttgctaccaagacaaacgatgtagcaggcgacggtaccacaactgcaaccgtactggctcaggcaatggttaatgaaggtatgaagaacctggcagcaggcgctaaccccattatcctgagaaaaggtatgaagaaagctactgaatgcgcagtagaagctatcgcaaagatgagctccaagatcaacggcaaggagcatattgcgagagttgcttctatttccgctggtgatgatgaagtaggaaccatggttgcagatgctatggaaaaggtttccggagatggtgttatcaccattgaagaaagcaagaccatgatgacagaactggatctggtagaaggtatgcagttcgacagaggatatgtttccgcttatatgtgcacagatatggacaaaatggaagcaaacctggagaacccctatatcctcattacagataagaaaatctccaatattcaggagatccttcctcttctggagcaggttgtacagagcggcgccaagctgttaatcattgcagaggatgttgagggcgaagctcttaccactctgattgtaaataaactgcgtggaaccttcaatgttgtagctgttaaagcacccggctatggcgacagaagaaaagaaatgctgcaggatatcgcaatccttacaggcggcaaggtaatcagcgaagaactgggccttgacctgaaagaaacacagctcagcgatctgggacacgcaaaatccgttaaggtacagaaagaaaatacggttatcgttgacggcgaaggcagcaaggatgaaatccaggcaagaatcggccagatcaagaagcagatcgaagaaacaacctctgatttcgacagagagaagcttcaggaaagacttgccaagctggcaggcggcgtagcagttatccgtgtaggcgctgcaaccgaaactgaaatgaaggaagctaagcttcgtatggaagatgccctggccgctacaagagctgctgtggaagaaggtattatcgcaggcggcggttccgcttacatccatgcttgcaaggatgttgccaaactggctgaagatatggacggagacgagaagaccggtgcaagaatcgttctgaaggctctggaagcacctctgttccacattgctgcaaatgcaggactggaaggcagcgtaatcattaacaaggtaaaagaaatggaagtaggcatgggcttcgatgctctgaaagaagagtatgtgaacatggtagatgcaggaatcctggatcccgccaaggttacaagaagcgcactgcagaatgcaacaagcgttgcttccacattgctgacaacagaatctgttgttgctgatatcaaggaagatcttcccgcagcacctgccggagcaggcggaatgggaatgatgtaatcagtaccatataatgaaagaaaaaactatactgactgcggccgaaataaaacggccgcagtttttatgtggagccggaagttgagaccccaaagcggtgtttgcccggcaatagataaaagacagtattgtggataaaccctttgtgcagctgccggaggctcatggatataatttggacttactgtgtaaagcgggatgattagaactcacgccatattagaaatatctttactgtgaaagaattaggtgataaagtgaattattgcattatttacaataccagtcagcaaggagcaatgttagctgcatgcctgaataatcaggcataatctggaaagggaagattttatggcagaaagaataagcaatgtaaccccatggcctgagaacaatatgaaaaattaccaatggttggatgactgcctgcaaaaacagccctctacagaaaaagaattccaacctgcatggcaagcatacaaatatctgctttgcggcaagatgtacgcctatatcggcatagatgacagaaacggacggcctattgtcactttgaaactggaccccgtcttcagtgatatgctgcgcggcaaatatgaggacatcgtgccaggctactacatgaacaagctgcattggagcacaatatatcttgatggtactgtgccgcaagaagtacttactgatattgtgcatgcttcttataaattggtacgttcatcgttaagcaaaaaggcgcagcaggaaatacaggaaaaatagagacttcttttaacagctgcattgaaacgacaaatttaaggttcgggagaagaaaatgaaaattttgcttttgtgcttaaaagcttttgaaactatggaattcagcccgtttattgatatcatgggctgggcacatgatgatttcaattgtgatattcacgttgatatatgcggatttaatcccaaaattctgagtacctttggggtaactataacagcagatatcttaatcgatgatgtggatgtgaataattatgatgccttggccatacccggagggtttgaagaatatggtttttatacagaagcatatcatgataaaacgcttaatttaatccgctctttctactcgcagcataaacctatagcatctgtatgtgttgctgcctttcctttagccaaaagcgggattttaaataagaaaaaagcaactacttatcatctgcgcggtggatataaaagaaaagaattagaaaaatttggtgtgatacttggagatgagtggcttgccatggatgataatataataacgtcttcatgtccacggacagcacctgatgttgcatttcgattattagaattacttacatcaacagaaaaagctgcagaagtaaaaaaagcaatgggatatcagtaaccctcatagttaaagaattatgaaaaagcttaaggcttctgcagcagatgcagaaaccttaaaaataatcagccctataattccctttcccattttcctttgccagatacattgccttgtccgccgcccgataataatcaaaataggaaggggcatactctttattgacagcaactcctatgctgacactgacaggaatacagtcttcacttaattcgttcgtacggcagagaatttccgtgcatatccgccgcaccagcttttcatcatccgtattataagcgaaaagcccgaattcatcgccgccgatacggaataccgtatcggttttgcggcatacacaacggagtatatccgcaaaatgatgcagaatttcatctccccgataatgcccatatgtatcatttatcaacttaaaattatcaatatcaaacacgaacattgcattatgcgtggaaggactctgctgcataagcttattctgaatcagctgccttccggctgcggcattataaacaccggtatgacaatccatattggctaaatgctgaagcttcagcctctgctgcacttcataatcaatatcctgaaaaaaacctatcgcctgcagccgaccggatccagaatccacaaaagaagtgaaaacaacacgataccaattataatcacgactgataccagaccgtgcaagaagctcggcggttagagtacaatcctgaatttcaagcgaatgaaacaaatgagaaagggaaggcagataatcaggatgcagcactcccgcatccacaagcccccgcgccccatcagctacaatctccggaagcccgcaccgttttgcacattccggttccgcaaataacctatgcgtctctgtatcatattcccaaatcatatccgcaaaattccggagcagaatccccagcttttgtgaattcaaatcccatttttccttcatttgttatatcccatcggctttctgtcaatatcttaaaataatggtatcatccattcccatgtcccgcaatctggcagagaacgtaatatttcgacaaaacaagacaagaaccccccttttatgttagaataataaagtccgtaccataatttactgaaatacatttcctaaaaaatgttctgtccataagaagaaagagaggaaatatgaaaaaaatgacctacgtatttatagcattaggagtcatctgcctcctatactgcgccggaatcctcatatccggagtatacggctcctggttcttcctcatctggggaataacaggaaccgccttcctcgcgctagcatggctctaccagaaaaacatctggctcagactccccggaatcatacaaaaactcatgatcgccgccatcctgacaggagcattcctattcctgtttatagaagccatgataatcagcaaatttaccagcaaaggaattcccgacctcgactacctgatagtactgggcgcccaaatgagagagaccggcccaagcaaagcccttgccttacgcctggacaccgcagccgcctacctgacagaaaatccagacacactcgtagtagtctccggaggaaaaggcagcaacgaaccaataagcgaggcccagggaatgtacgaatacctgcttacaaaaggcatctcccccgaccgcatcctcctggaagaccgctccaccaacaccaaagaaaacctgcaattctcccgccccctaatcccacaggatgccaccgtaggaatcgtaaccaacaactttcacgtataccgcagcacccgcctcgccgcccaacaaggctactctcaagcctacggcctctcagccccctcagacacagccatgcaagccaacaacatgttccgggaattcttcggagtagttaaagatctcctatacggaaacatgaccctacgctaacacaatatcccttttacgtaaattctgtctatatccctagaacattaccgttccccaccgaacagtggggaacggtaatgttcgcactcccccggcacatattttgctcggttgacttatggagggagaaataatataataaaatatagttttttagggaaaaatgaccagaaggagaagtgccatgaagaaactggaagagtatgtgagatgtataccggatttcccggaggaaggagttatgttcagggacgtaaccagtgtcctgcaggatgcggacggcctgcatcttgccatagataccatgcaggagctgatagatgatttggaatttgatgtagtggtcgggcccgaatccagaggattcattttcggaacccccattgcttataataaccataaaccctttgttttaatccggaaaaagggaaaactcccctgtgaaacggcttctatggaatacgatttggagtatggtacagccgtgatcgagatccacaaggacgccatccgccccggccagaaaattttgatcgtggatgatctcattgccactggcggaaccacggaggctatgatacgcctggtggaacagctgggaggcgaagtggtgggagtcgtggtattaatggagcttgcaggccttaaaggacgtgaaaaactggcaggataccgtttggagtccgccatttgttttgaagggaaataggtgaacggagtcggaagccaataacatgaaaataaaaaaacagcgccggtagggatatgaatatgacggatgaaaagatgacggataaggtgcaggccgcggttccagcggacacggtcatgcagccggaagaaaaaagtaaaattgtgtatgagggcggcggaaatcttgccggtgttcagagaaagaaaggcaaaggcctgattcttgacgatggacggatcgaagccatgaaagaatatttaagtcctgaggagctttatcaggaccttatttcccgtgtgcgcagataccatccgtcggatgatatatccatgatagagaaggcctataagatagcttacgccgcccacgagggacaggtgcgcaagtcaggggagccttatatcattcatcccctatgtgttgcgattatccttgcggatttggaactggataaagaaacgattgaggccgggctccttcatgatgtggtggaagataccatcatgacagaggcggaaatcgaaaaggaattcgggcctgatgtggcgctgctggtagacggcgtcaccaagctgcagcagattgatttccccagcgataagggaaacggggaaaacaagaccgcagatcagcaggaaatgcaggcggaaaacctgcgtaaaatgttcctggccatggccaaggatatccgggttatcatgataaagctggcggaccgccttcataatatgaggaccctgaaataccagcctccggcaaagcagcagaagattgccagagagaccatggaaatttatgcgcccatcgcacagcgcctgggcatttccaaaataaaggtagaactggatgacctttccctgaaatatctggagccggaggtatattatgacctggtggataaaatagctgtacgcagaagtgaacgggaagaatatatccagcagatcgtggatgaagtgtcggaacatatgaaaaatgcaggtatcaagtcacagattgacggccgtgtgaagcattttttcagtatttacaaaaagatgaagaaccagagtaaaactctggatcagatatacgacctttttgctgtcaggattattgtggattcagtgaaggattgttatgctgcgctgggagttatccatgaaatgtataaacccatacccggacgtttcaaggactatattgccatgcctaaggccaatatgtaccagtctctgcatacaacggttatcggaagctccggccagccttttgaaatccagatccgtaccatggaaatgcataaggcggcggaatttggtatagcggcccactggaaatacaaggaagcctctgacggcaagaaggttgcggcacaggaagaagaaaaactggcctggctgcggcagatcctggaatggcagagggatatgtccgataataaggaattcatgaatctgctgaaaagcgatttggatctgttttccgatacggtttactgctttacccctacaggggatgtgaagactctgccggcaggcagcacgcccattgattttgcgtacagcgtgcataccgccgtgggaaataagatgatcggcgcccgtgtaaacggcaaactggtcaccatagactatgaaatccagaacggggacagaatagagatactgacctcccagaattccaagggacccagccgtgactggctgaatctggttaagagcacacaggccaaaaataaaatcaatcagtggttcaagaacgaattcaaggaagaaaatatcataaaaggaaaggaaatgctgaatgcctactgtaaggcaaagaacatcaacatttccgatatcatgaaaccactttacatggaagctcagatgaagaaatacggcttcaaggactgggaatccctgctggcggctgtagggcacggcggcctgaaggaaggccaaatcatcaaccgtatgcaggaactgtatgacaaggatcatcccaaggtgctgagtaatgaggaggttattgccagtgtggctgaaaacgcccaggcaagacagatgcttccccgtgccaagagtaagaacggtattgtggtcaaggggattcacgatgtggcagtccggttttccaagtgctgttctccggttcccggtgatgagatcatcggtttcgttaccagaggaagagggatttccattcacaggacggattgtgtaaatgtcattaatctgcctgaagtggagcgggcaagactgatcgatgcggaatgggaggcctcacccgaaaacagggccggtgaaaaatatctggctgaaatcaatatttatgcaaataaccgcagcggccttctagcagacatctccagagcgcttacggaaaagaatattgatatcctttccatgaataccagaacaaataagcagggaatggccactttgtccgcttcctttgaaatcagcagcagagatgagcttatccgtattattgataaaatccgtaccattgacagcgtaatcgatatagaaagaagttaaatacatggcgaatataaagatagggcgcatggtgttaagcatgtgccagaccaattgttattttgtatacaaagatgcagaggcttccgataagacatttccggcggatgaagcaggtgagtcatcgggaaacggcggttctggggaaaatggcagccaggcggcagaagaaaaagaggtagttctcgtggatcctgcggatcagggaaggcagatttacgaagccctgaaaggaaagggctttcgtgtatcggccattctcctgacccacggtcattttgaccatatctggggggcaaacgaactgcgcaggctgtcaggggctcccatttatgcctatgaagaagaaaaaaaggtttgtgaaaacgcggcaatgaatgtttcagaccaggccggaagaccggaaactgttattccggatcattatgttaaggatggcgaactcctggaattcgcaggaatgcgtttccgtcttatcgcaacaccgggccatactgcaggaagctgctgttattatatggaagaagaaaaaattcttctttccggggacaccctgtttgaaggttctgtcggcagaacggatttccctacaggcagcatgagcagtctggtgagatccatcaaggataagctcctggtgcttccggaggatgtaaccgtttatcccggacatggagagaaaaccaccatcggggatgaaaagaaatataatccctattgccagtaggcgctatacttaatttaaagagttattttgatgataaaataaaaggggatgtttatactctttttaaagagtaaagcatccattatcaggaacatccgtacaaaccaatcggcgcagggctggattggtttgactcatgtttatctgcaatttggaaagggacgggcgatatgctggcagtcaggcttaacaaagcacaatttgaatatgatatacactccattatcaaagccttttatccggcggaaacagtgaaggtttttgaagaaggaacgaaagattttgaatcagatggggataatccacagattaccatccgtttcggagagaaagaaatccgggtggagctgtccggaacagaatacgagacagcgctgagcagcccggaggaacggcctgttgttaaaaatgaattaaaacagctgctgtaccggattctgtcggctcatacaggcaaaaaattgccatggggaacacttacgggaatacgtcccacaaagattgccatgcagttcctcgaagccggaaccggcggagatacggaagcagatccgaagaatccttccactgaggcggaaatactggactacatgaaggaaacgtattactgcagtgaggaaaaagcacttctggccattgatattgcaaaaagagaaaagcggatactggcagatatccattatgacaaaggctacagcctgtatatcggcattcccttttgccctaccacgtgcctttattgttcctttacttcttttcccattttttcctggaaagatcgggtaggagattatcttgccgccctggaaaaagaaatggatttcgtccgcgatgcctgcagggataaaatcctggacagcgtgtatatcggagggggaacgccgaccacgctggaaccggaagagatgagacggctcctgaaaaaggtgagggatacctttgatttttcccaggtaaaggaattcacggtggaggccggacgcgcggacagcattacgagggacaagctgagagtgatgaaggagtacggcgtaacccgcatctctgtgaatcctcagacaatgaaccaggaaaccctggacttaatcggacggcggcatacggtggagcaggtggaagaggccttccgcctggcaagggaagaaggctttaccaacatcaatatggatttgattctcgggcttcccggagaaaccagagagcatgtggaacatacgatagaagaggtaaagagactgcatcccgacagccttaccgtacattcactggctatcaagagagcttccaaaatgagcctctggatagaaaaaaacggaatagaaacactccataacacagatgagaccatggaaatcgcagctcagggagcggcagaaatggggatgaagccctattacctgtaccgtcagaaaaatatgtccggcaattttgaaaatgtgggctatgcttcggaaggaaattatggcatctacaacattcttatcatggaagaaaagcagaccataatggcgctgggagcgggcaccatttccaaggccgtatacccggacggcaggatagagcgctgtgacaatgtgaaggatgtggcgttgtatatggaaaaaattgatgagatgattgaaaggaagcgtaaactgcttcaaaattaatttcccttgaaaaagaagggaaaaaagtgtaaaatcggttaagattatacaagtccgggtatccggacctgtattgggaatgaaaagccccgaacgaaacggaacaggaaaggaacggatggatatggcattaagcaagaaaccggtaaccggtatgaaggatattctgccggctgagatgcagctgagagattatgtaatcggtgtaataaaggatacctatggtaaattcggatttacctctattgaaaccccttgtgtggagaatattgcaaaccttaccaataaacagggcggcgacaatgaaaagcttattttcaagattatgaaaaggggagaaaagctgaatctggaaacagccaaagaagaggctgatctggtggacggcggactgcgttatgacctgaccgttcctcttgtccgtttttattccaataacgccagccagctgcccacgcctttcaaggcgctgcagataggaaatgtatggcgtgcggacaggcctcagagaggacgttaccgtcagttcatgcagtgtgatattgatatattgggagaaccttccaatctggcggagatcgagctgattctggcgacgaccacaaccctgggcaagctcggttttaaaaacttccagatccgcattaatgaaagaagaatcctgaaggcaatggccgcttacagtggattcccggaagaaagctttgacaccgtatttatcattctggataaaatggataagatcggcctggatggcgtggcaaaggaactgctggaatgcggtttcgcacaggagagcgtggataaatatctggatttgttcagagggctggaggagacagacgatgggctcggtttcctggctgataagctttccggtgtcctggatgaggatattgtcaataatctcagggaaattaccgacagtgtgagttctaccaaggcagcggagttcgatatggtttttgatcccacccttgtgcgcggaatgtcttactataccggaactatttttgaaatagcgattccggaattcggaggaagctgcggcggaggaggccgttatgataaaatggtgggcaagttcacaggcaatgatgtgccggcctgcggattttccattggatttgaaaggatcgtccttctgatgctggaaaatggtttccagattcccggaaaacccggaaaaacagcgttcctgattgaaaagggcgtggccggagaggaactgtgcaaagtgattgcccaggctcaggaagaaagaaccaaaggaacccaggtcctggtggcgaggatgaacaaaaacaaaaagttccagaaggaacagcttatgaaggaaggctgggaggaattcagggaattttaccagaaccctttaaaataaatcttaagatgaaggagacagatcatggctgagtcaatgaacgggctgaaaagaagccacagatgcggggagttgtccctgtcgaatgtgggagaaaccgtcactgttatgggatgggtggccaaacagagaaataaaggcgggattatatttgtggatttgagggatcgttccggtatccttcaggttatttttgaagaaagtgatgcaggtgcggaaggctttgccaaagcggagaagctgcgcagtgaatatgtcgtggccgttgtgggtaaagtagaaaagagagccggtgctgttaatgagaacctggctacaggtgaaatcgaagtcagggcatcccaggtgcgtatcctttcggaagcgctgacccctcctttccccatagaagaagagtctaaaacaaaagaagagcttcgtctgaaatatcgttatctggatttaagaaggccggatttacagagcaaaatcattctcagaagtaaaattaccatggcgattcggaaattcatgtcggaagaaggctttctggagattgaaacgcccatgctcaccaaatcaacgccggaaggtgcaagggattatctggtgcccagccgtgtgcatcccgggaatttttatgcgcttccccagtcgccccagattttcaagcagcttctgatgtgttccggatatgaccgttatttccagatcgcaagatgcttccgtgatgaagatctccgcgcggacaggcagccggaattcacgcaggtggatatggagctttctttcgttgatgtgaatgatgtcattgcggtgaatgaaagactgcttaaatttatctgcaaagacgctatcggcctggacgttcagcttcccattgcgcgtatgacctggcaggaggccatggatcgcttcggttccgataagccggatacacgcttcggaatggaactggttgatgtttccgaaactgtggcaggctgtggtttcggcgtatttacctcggctttggaaaatggcggttccgtacgcggaatcaatgccaaaggacaggcggaaatgccgagaaagaaaattgatgccctggtagaattcgcaaaaggttatggggcaaaaggcctggcctatctgtgtgttcttcctgacggaagctataaatcctccttcgctaaattcatgacggaggagcagctgaaagccctggtggaggctatggatgcggaaccgggcgatctgctgttatttgcggcggacaagaattccgttgtctggaatgttctgggcggcctgagactggaactgggcagacagctgaatctgattgacaacagtaagttcaacttcctctggatcacagagttccctctctttgagtggagtgaagaagagaaccgttatatggccatgcatcatccttttaccatgcccatggaagaagatctggcgatgctggagacagaacccggaaaggttcgtgcgaaagcatatgatatcgtactgaatggtacggagctgggcggcggaagtgtcaggatttctgatgataagattcaggaaaggatgtttgaggcacttggctttacaaaagaaagcgcatatgaacgcttcggattccttctggatgctttcaaatacggagtgcctcctcatgctggactcgcttatgggctggacaggcttgttatgctcctgaccggcgcggacagtatccgtgaggtaattgccttcccgaaggtaaaggatgcttcctgtctgatgacggaagcccccaatgtggtggatcagaagcagttggatgagctgggtatttccattaatcctattgaagaaaaggaataagagtaaaagccttggcagagaaacaggaacccctggaaaaattacaggaacaattgttgcatacgtcccggatggaggatatctgtgatcatttgatggaggcggcggctgaactgacgcagtgcgcagggctggcgcttttcctccggtgcggggaaacgtccgaattcgagcagaaaaggcttgcgggctgtttccctgaaatccccggaagcgtgaaggaggaactgtttgacagtaccttccttcgttgtgccttcggcgcggaaattgccggcgaaatgatctataaagacaggaaatatggtttctttcttgtttgctgtcaggagtgtaataaaaaggaggtgcagggagaaaaatgcctgcgtctcctttgtacgttgggaatgctggctttgcgcagcgggtggtatgccggggaggcttggataaaatctgtcaccgatgatgtgacgggagcctataaccgcagataccttttgaaacgcctgaacgaggatatggggaattctgtcctgcaggcggcgctgattgacattaatgtggatgattttaagctgtataatgaaatgtatggctatatgcagagtgacagcctgctgctgtttgtggctgatatcatcagggtagagaaaagcccgcagggagaactttaccggtttggcgctgatgaattcctgctgctggagccgggtatggcggaagctcaggcgctggaaactgcggagcggataaggaagaaaataagacaggtgagtaaggataaaaagaaactgattcacccgctcactgtgagctgcggaatcgtcctgtttccggaaaatgtggctgtaaaagaggatttgctgggaagctgttcccgtgcggtctattatgcgaaagtaaggggaaagaatcagacggccctttggaagaaggaggatcatcccagggagggaagcggctattaccgcagttcctttgaaaaaatagcccccacaatctttgcatttatggcggcggttgatgcgaaggatcagattaccttccggcattcccttaaggtatcggagtatgccaccactcttgcccaggcgctggggcttaaagaggaggaagtggagatcatccgggaagcaggacttctgcatgatatcggaaaaatcggcatcccggaaaatatcctgaaaaagcagagctttcttacagaggaagaatatgcggttatgaaggagcatgtgaagaatgcaacggaaatgatccgcttccttccggatatgaactatgtgcttcctgcggtagtggctcatcatgaaagatatgacggaaaaggatacccttcaggactggcgggagaggatattcccctgggaggacgctgcctggcaattgccgacagctttgatacgatgacggccagacggccctataaagaacccatgcggatttcctatgcggtcagagaactggaaaagggaaaaaatacacaattcgacccttatctcacggatgttttccttcagctgatagaggagggaaaaatccgggtgtggaacgggcaggaagagtagtttgttttacaaacagcgagccagggtcaggaggacttgaccctggctcgctgtccgcctggcatcgtcggccgccgcgggaagcttccccttaagggaatcagctgttgtagttgtttgtgccgtttatgatgatttcgtaatcatcatattccagatcattgtaatccgaatcataaggagcagagaattccacgttggcttttttctccatatcggagatatactgggaagtaatgcctatggcgctgccatctttataataaatacacatcagttccacagaatcgaaggtcatgcctgtgggattggtgatggaagcgaggacactgcctctggagcccggatttgattttatctggaactgtgttccgtaattctggctgtaaaacctgtaatcaacctctttggcaagagcggtgatttcataacggctgtacgggatgtcattgtagtctttgtcataaggataggggacatcgacggcggccctgcctcctgcggcacagccccagatatagctgtttctcaggaacagaagatcgtcgttttcatcataataggtcacagtgatttccagctggacatccactgcgtttttgttttcatagaccaggatcaggcttttgggagcggcataatccgtctgcgtgatgttgggcatcagcatgctgctggtggctttttcctccgtggtaggtacataaacctcccgctcaacgccccgtaccgaccgatcctggctgatgcctatggtatagtaaacaagaaaggtgagtatgatggaaaggaatgccaataccattcctgcgataggaaggccttttttgcggttattctgtatcagagaaacaatgccgagtatgattgcaaggacatcgagcgcgattccgacaaaaaacacgccggacagaaaaccgagaataccgagtaccagacaggcaatggccagtccgctgttccggctggaggaatcgttcccctgattgtaagggggattcggctgataggggccgttggggtaagcggggcctgtcggaagtgggccttcattcggaaaaggagagtaattctcgccgctgtaataggtgcgtgaggtctgaggagcgtaatactgctgctgatttggctgatttatgccggccctgccgtcattcggctggttccattgattgctgttatcgggggagccatagccctgcccattttcattatcatacataatttgtccctcattcttatgctaaatctgatgaatattataaggcatggggagatttttgggaatagaagaattaattttaaagaaaacttcattatttattaaataaaatgtcctccttttgctggtatactatcagaagtaagtttcatgtcagaaaatctgaaaacagaagataaatccaaaggatgaagaaaaatggcaaaacgaggggtacggacggaggcaggcagaagatattatccggatggaagctattattcaggcagaaatgccggggcagcggccagagaattggaatacatcgacataacgctgagggagaatcctccgaaaaggaaaagaagcagagaagaaatcctggcaagaagaaagaaaaggcggcggcagcgcaggattgcacagatgctgatggcaggctgtgtcctgacgatgggaattatgctgggattccttttatggaaaataataggttttgtacaggacagaggtgtttttaaccaggttatggatgaagaaagaaaggaaataatccgtgaaaatgacacaattaaaccggtgatcacggaagattttctgacggtaaatccatattcccgtcccgcggagcctctggatggggtaaaaaatatttttgtgcattatacggcaaataaaaatacctccgccaggcagaaccgtagttattttgaaaatctggggatcactggcgaaacctcagccagcgctcatttcatcatcggatatgatggggaaatcattcaatgccttcccctggatgaaataggctatgcggttaaaacgagaaactatgattccatatccatagagtgctgttatcgtgacgacagcggtaaatttaccgatgccacttatcagtcccttctgcagctgacggcctggctgctgaaggaatataagctggctccgaatgatgtcctccgtcattatgatgtagggggcaaaaaatgtccgctgtattttgtggagcatgaggacagctgggaacagttcaggcaggatttaaccgattatattttagagaagtaattcaaccggagcatccgccggagatatattctgcgggaagcaccgaatgtctgcttagataaaagaggaataggatggaagggaaaaaacacaggaaaagccgcagaaagcagaaaaacagggaaggggcagtactggtattgggagcagtgctggtaattcttctgatagcggcggcagtagtaattattttaaaaatatcatccggcgggaaaagcagggagaccgggaatttagcggagagtgtatcggaatcgacagaagcagaggaggatacggagagtattcctgagtcggaagagagccgggaaacggaatcggaaaatccggaaagcctgccggaagaaccgcaggccgcagtggcggctgaggtgggcagcatggaggacgagggagatcctcagaaatcttccaatgcctccggacagggaaacggcgcttccgtatccataactacggataccctgaagcccacggaaggggaaacggctgagatgacgctggggatcgatgtttccaagtaccagggcggaaatattgactggtctgcagtaaaggcggccgggattgattttgccatagtccgtgtgggatacaggacaaaggctacggggattatctatgaagaccccgcagcaaggtataatattcaggaagcacagaaaaacgggatcaaggtaggcgcctatttcttttcctccgcagtgacggaacaggaagcaagggaagaagcttcctgggtggcggattttatttccagatataaaataacctatcctgtggcctataactgtgaggatttcaagtcggaagacagcaggcagtacggcctggataaaaccgtgcgtaccggcattgcctccgcattccttgacagcattcaggcggcgggttatacgccgatgttctatgcctccaggaatgaaatggaaggaaacgcagactgggatatggatgtgctgggcagcaaatataaggtatgggtatctcagtatccggaaaagccgttccccgacactccctccgccacttactccggaagacatgacatgtggcagtatacaagccagggacaggtggccggcatcggcaaaaaggttgacgtaaatgtagcttattttggttacagtaaggaagcggaggccaaggactccaccccggcagaggtagtggaggctaatccggaggtgggcattacatttacggaagtacaggaaacggttactgcaaaaatagagacaaatctccggacggctccgactacggcggacggttcgcaggtggttgccaaactggtgaacggccagacggcgacccgtaccggagtggggaataacggatggtcccggctggagtataatggacagaaggtctatgccgtgagcagttttctgactgcggatctcacttatcaggcgccagcagaagaaaaacctgctccgagccagacctacgaaccggtaaatgaaacggtaaccgccaaggacacaacaaacctgcgcacggagcccagtacggccagccaggataccattgcggtgacgattcatttcggggatacggtcaaccgggtgggaatcggcagcaacggatggtcccaaattaattataacggacagatattatacgctgtcaccagttacctgacaacggatctgaattataaaagcagtacgacgcccacaccggataatccggaggccggcatcacttttaccccggttaatgatgttgtcacagctaaaagcgaaacgaacctgcggaccgttcccagcacggacagcccggatacggtcataggagtcctccataatggggaagcggcggtacggaccggaatcggaagcaacggctggtcccggcttgaggtgggcggacagacagtctatgctgttaccaattatctgaccggagcgcagtgacggaaatcggataggcacttgacatatttttagagagttcatcctttcagagatgcccatgttataaaagtacaaagttagaaaaaaccagtaaaatcaagagattgcactactttagtccttttttatgcctgtaggataagtattatcattatatttcaagattctactttgaaaattttgatgtatatattacttcggtaaacgttttcctggtgtcagtgttccccctattgcaagacgcttaaaagtccagtaaacaaattaagccggttgcttaccatgctttttgcatacttctattgaagccatattgatagacttaatgttgataaatatttttctcctaatcacttgttaaggcggacaactctgattcagtgattgagaaaaaatggtttatgggatataatggtaggaaagatgtgtgtaataaaaattgatgcaaagtatgtaggttaatttttgtggaggatactatgaatgtgtgagggtattggcgatgcataatattgaaatcaatacatttgtaaatagttttgcgattaaaccgaataatagtatgtcatttctccttggggcgggggcatctatatcatcagggattttatctggtggacaaatggtatgggattttaaaagaaatttatactgtgcttcaaaaaatattagaacaagtaattttcctgatatgtcgaagaaaaatgcacaagatgagatacagaggttttttgatggacaggcagggaatcctagcctttggtcatcggaggaatattctttttactttgaaaggtgttatccagccagaaaggatagggaattatatatccagaataaagttagggatgttaagccttcattaggttatttatgtttaggtgagcttattattcatgagaaaataggtgtagtatcaacaacaaattttgatgatttggtattggctgggatacatagtatcaggcctgatttgtcggtaaagacaatatcatctgcattaaaaaatagtacaggattttttgtgaatgatggatttcccaatattataaaattacatggagattatttgtatgacaaattaaaaaatacagataaggagttgcagaaattagaaactgaaatatcagggatatttagagatgctgtaaaatctggagggttaattgtattagggtatgctggaaacgataattctgttatgtctgtgttggaagaacttgtttcttcgggtcaaatccgatatggtgtgttttggtgtcagccaaaaggttttccgctgagtaagcgggcacgggagtttatagagaaagcatgtgcatataatgaagaatcaggagtagtagaaatcaataattttgatgattttatgtatcgtttatttcttacattgaacatacaaaactcttttattgacagtatgtgggaacagagtggtatgaaacagccaatattatatgaaaatattggtaggcataaatcaacggcagttacgaatgctctgtgtgcattacagtatccgcgtaaatgttatgtgtttaatgctaatatttcatcatggaaagagttaagagaaacaataaatgatacatgtgttgctgtgttgtataaaggaatggtctgggcgcttggtagtaaagcgggaatagttcatgcttttgcaggtaagattaatggagatatatatgaattggatatccctttatacatgatgaaacttgaagattcagatatactgggaatgttttatgacattatagggagaggattacagcggaaagggttagtgtcctatggaaaccgtaaacatcataagtattttaatccatctagtaaacgctttaaaaatggccagaatatttatgatgcggtgaagatttctttgtcatttgtggatgatcaattggtattaatattgctaccaacagttcatttattaaagagggatggaactgaactggagaaatttgattatcagaaattagtaagtcaagaaatggcaacgcattataataaagtagttgatagcgagattgaaatttggcttaagtttatatcaaataatggaaagataatatttgaattgggaaatgctatattggaatttaataatgtaagaatacaatattctggtaatggtaacttaagcaaatgctatcaggtatccgaaccagaattgacttttagttatgaaaaagataattgtatagctactaatcaattaaggggattaataaattatggtcccatagaaacatatgtgaataaggcaattagacttgcggtattgtctccaaaagaatgtgccgcagatatatggaagcatttacaaaagttaaatgaacatcatgttacaagtttgattcaagatgctaattttttgccagagtatacgggttttcaaaatgtttttagatgtaatttagatataccaaatggaaatgatgtacatagatttaagggatatagcatagataaagttatgcaattaaacgcaaagtcttatttttatgggatatgtaagtatattgatgcatttgaaacgcaaagatcgcagtatgacttattagtaatttatattccaaaacaattgacacatattcgtgaagcaaaaaacaattttgaatattttgatttacatgattctctaaaaatatattgtgccggaaaagggatcgtaacacagataatagaggaacattcagtgtataccaataatgacactgcaaaaattatatggggactttcaactgcaatatttacaaaaaccgcaggaagattatggaaacctagaagatattctatgaatacagcatatgtaggattgagttatgtccaatcagttaagaacaatgagaaagtatctattgggtgtagtcaattatttgatgcagagggtaatggtatgaagttatatcttagacctttaatgaaccctcagattattcaaaataatccgtttatgcgaagcgatgatgcatgtcgtttaatgagtaatttgaaaaggatgtatgacgactctgtgcctttatataagttgaacagaatcgttatccataaaacaacttttttcacaaaagaggaaatggaaggaattacgaaggggttagctggggtggatgatattgaattattgcagattcaggaatttacagcttggcgtgcgattagattcgattatgataagatagctcctttcccaatacaaagaggaactgttattcccttggatggggacacttttcttatttggacacatggaagtgtacaacatgatgaattggcaggtaagaataaaaattattataaaaatggtcggggaatacctgcaccgttattggttaaacggtttatgggtatatcaacagctgatgaactggttaatgaaatactaatgttgacgaaaatgaattggaatagtggtgatggtttgtataagatattaccagttacgttagactttgccaagacactttcaaaagtggctaaacaagatttagtggtttatgataaaccttatgattttcgatattttatgtagtttagtgattagtaaacaaaagtagtgtaaaaggcaatgtgtggaaagaatttacacgttgccttttgttagtttttctatatagtattgatgtaaatgtttcattatccgtggactgatttgtaactgattttatgcgatgataatctcatcaaatccacttagaaaactccagaaattttgattggagttttctgggtttcggaaggagttctcaagtatgaatgaagtaatgcaggttcgtgcggccagctggcctgaccattaaaaaatggtgtgttgccaacggaatcaaggagtccgcgtattataaccggttaaaccgactgagaaaaatgggacttgatgtttgtgaaaaaccgagtcccaacaaaaactatattcctgtttccagaacatttgctcagataccagttgcttctgccgtcccgtccctgaataaagcgattcgcatccgccatggtgacacagttgtggaagtaagcagcgatgctccagataacatcctttcttttatgaaagaagtaatgttctgtgctatctgaaatcaccgtctttcagatcatctatatctattgtggaaaatgtgaactccgcaaagggattgatagtctgacgaatttaataaaggaacagtttcatctggacccgtttcaaaaaaacgtcctgtttcttttttgcggatgccatatcgaccggttctggatcctggtctggagaaaatggattctgtctgctttataagcgaatcgaagcaggatatctccggtggccgagaagtcaggaagaagccgctaggatctcgctggtagaacttcatcttctattgactgggatgacgatattagaatgttcttccatctgggaatgcagctgtacagagatctgttgatctgctatgcggaaccgcccttttctgatagattatcccttagaaaacggaagggaggtatgcatcggtgtcacttttgcttacagaaaaagagcttgcgaaccttgacaaacaaacattgatcaaaatgttcgtgacagccactgaatccaaccagaaactttctgaggctgccgaacagcttcaaaagagtgtaaaacttctgacagaggaaattgtaaatctgcgtcagaatcggttcagccattcttcggaaaaaggactgaccagtattgaaggtggttgtagccaactttgtttcactttcaatgaggtagaggtaacagtggttctgaatcttgtatttcccgaaccggagctggaagatatcgtcccgaaaacgtacaaacgtggaaaaaagaaacagggaaccgtcaggaagagattaaatatattcctgtgaccgtggttacccatactctattcgcgcaagaactgcttgctgcatttccgaccggtttgaaaaactttcagacaaagtatataaacgtctgggattccatccagcaagctttgaagagatcggaagtatacataagtgcggatagtgggagctttgcacgggtgcaacgcccagcgaatctatttcggaacagtctggtttcagcatcccttgtggccggtatttgcaacctgatgtatgtgaatgcgtagccgattgtacgtctctccaaagaggttgagcacagtgaagtatttcttccaacgcagactctgtgccgttgggtgatcatgggagcggtacggtatttgagctatgtatacaactgtatgaagtagaaacttcctgataatcatgttgtatacgcggatgaaactgtggtagaggtacgaaaagatggttgaccggcaggagctgagagaaggatgtgggtttatcgtttcggtgaacaggagtctaacccagtcatcctttacgaatatcagaatatctggaaaaaagggacattcccgggagttcctgaaagacttcagtggggctgtgtgacggatgattaccaggtataccattctatttcagggggatgggaggatctgacaatcgtcggatgttgttcgtatgcccggcgagggtttgccgatgtggtaaaaattgccggtaaaaagttcggaacatcaggaaatccgttgcctataaaagccttcagtttcatacagagaataagccggtatgatgataaaattgccagtatggaaccagttgggcgtctggaagcatgtattcattatgtactttgaagaaggcagtgccagtaagaatatcaaagtttcgacagcgatatatgagaagtatttgcggatagaaatctgatggatgtagcaagaattatgggagaggctctgtaaacaaggtttaagaaaggggtaaactggtatttaatgcgggcatagccgttttattggagtctggaataaaacagatcatcaggggatatcctgtcgatattttggtgataattagcccctaaatttatagacttaaaggtgaaataaatactgaacttaggatggttagaagaagaaatataatatgacagaaaggtcatggggagaattgtctagaggtcgaggagaaataccaggatgtttattaaaaaattttgcgattatactgggatgatatggtacaattaagatatttgttagagggcggacatctggaaagaaaagaaggattatgaattatatacacatggacgatttgagcgggtgatataataggatgaagaagcagtttctggagtaattgtcgattgcgcttttctgtattcttggaatcatgagcagagatcgtgtagtattgatacatattaggaaaagatttggcatggcggcgtggtgtatgttgaggaagagtacctggatttgttatttgcgagggaatgagaagtgattgaatttgacaggaagaaagctatcgtgataggcgggacttatagggttgataagatgcctccggttcatatatgggtatggatggtgggcgaatgaacagctgtttgaggagattatgagagatgtggaatggaaactggttgaatgaaggaggtgaatgtgggggtgagtcataccacgccgcttaaatttgagccggataagtctgcggaggagtggatgaatgggattgagaaacggctggagtatgagatggagtattatgggcattatcatacggataagaagattaacaagggagataatgtttgagaatttggatgtgttttgcggtagataaataatgtgaccataataatcaatgcattataaaaagttatttttattaacccaatatttaagggatagggagagatttatgaaaagaaagtttaagataaaggggaaaaagataataataactattcgggagtttcttacaagacttaattggttgtatatatcaattataattatgatagttatcggtataggaatattggcagcttcatatttggtaaatgataatgatgcaaaaaatgtttgtgttggcttaggaacaggtattgtgacttctgcattggtatctttgtatattgatgccattaataaaaaagttgaaaaaaacaaattattccaatataaaaatatgcttttaaatcctttatataatgcaattaaatcgctctatatacacatttctataaatattaatgaatatcgggttagagaagaaatatcgggatatttgcttttgccgatggaaaaaacagaagatttgtctaactttcttaatgaactaatgtcatataaattggaggacatggtcgaagaaaaacagaaaaaattagttaatatgctctgtatttctgaaatatattatagagaacttataagtcagtttagaggtttgcctttagatagcttactatatgaaaatttaatctcacatgaggactacaaaaagttaaaaaattttagcttaattaatttatgcatggggaatcttactaaaatttcagaagatggtgtgtctgaacaggatgagtatgttttaaaaatacaattgcttcatggaatgatgttacagatgaatcggatattggaagtattcccagatatggcgagcaaaattgattctgagaatagttggattaagaataatttagctgagatttattataatgaaatatatacaaattcagaagaatattttgaggaaatgatggagaaaatggaagcagaacaaaagtattatgcagaacatccagatgaatgggaaaatgaggcagaggaagagacagaagaagataggttgtatcgtaaaataaataaagctatttgggcaggcaacgcagagacaattaaaaaatgttttcctgaaataaataaggataataaacaaatacaatctgaattaacatggagcttagcgagaaatgttatgaaggataaagaacttagaagtatgtacttcgagaaatacggtgaaaaatacaaaatgagaaaagataaaagaaaaggtttaaagagaaagtgtggcttgcattaatgagtttttgtctttaagcatgtgcagaaaaaagttataaaatttttgttttcctactcaacatattctgggggataaaagaaaaccagaatatttagagaggattatttttgatgctttggaacaagggacaaaaatgaaggatagaattattacagagctgagaaaggaagatctgccatgtgaagttgctacaatacgagaggtagttaagtggaatagagtagaacataaggaacatacaagcgaagagataaaaaaattttttaaggactgatagaaatttgcgacttcttccatattatattctttgattatttattataaagaaaagacgcacccattctggaaatacctgaaaaactgtgatacaatgacaaacgtaggcctgcagaaatgttttgctaaaacggcaatgacggaacgtaaaacgaataatgagcatggcctcggggggattgtatcgcatgaatacttttatagtttttcagcagatgctgatacttttggcgatgatgataataggctacgtgagcttccggaaggactggctggacagaaatgcttataccaagctatccaaaatcgtagtgaatattttgaatccgctcattattattaatggggtcatggagcgggacagtggggaaagtacggaaaaaatagtgctgaatctcatgttcattgtcctgtattttgttatcttaatcctggcaagcttccttgtggtgcggctgcttaaagtcgaagcacgccacagccacctgtaccgtatgatgatggtcttttccaatgttggatttatggccatccctttaatatccagtatctacggaaaagaaagtgtattttatgtatccttttacatactcggatttaatctcctgttatatacctatgggattcatttaatatccaggggctcaggagagaagaaggaaaaactgcagctgaaaaagctcatgaatccgggagtggcggcctgtctgctctctattgtgattttcatatggagaattcctgtggcggacagtgtgaaaagctttgtgggctatatgggaaatgcggcgatacccatgtccatgatgcttattggcgcatccatcgcccagacagatattaaggagcttctgcgggatgtcaaaatatatggtctgctggcgatcaagcttctggcgctgcccattgcagcagcattgattctacggaatttggagctgcccagggaactggcaggtatttttattttcatgctgggaatgccggtggccagcattgtagttccgctggcggcggaatacgaagcggatgaaatctgctgtacacggggaaccgtgctgagcacgctgttaagtataatcaccataccgattgtttctctgtttatgtaaaaagaataggcttcgtgttttccggctgtccctccgtccgctgtgcggcggcaggtacagccgtaatttattcctgcgggtaccgagccaaacggatctgcttgctgcatgcgcagaagagctgatttaccaggtccagagagttcctgcaatgccgtctgcaatggcccgtgctgtttcgtcaaatttctgatccagcagggcattgtcctgatcattattgatgaagccgacctcgaccagaacggcaggaatgttgctttggcggagtaccaccagattggggcgttcgttgactcccagatttttgtagcccacttcttccagctgccggttgatattggtggctatggtcccggcaggaagccatgcgttgtagaccaggctttccactccactgtactgattcggataagggctggaattacggtgtatggagataaaaatatcggaaccggatgcgttgccttcggcggccttttgataaggagattcatagatatcctctgtccttgcgtattttacattgaagccgtagctctccagaatatcgcctatggcgagagtgagagccagggtatcatctttttcacgtcttccgttatatacggcgccgggatccgatcccccgtgccctgcgtcaagaaatatcgtataagtgtaatctgccataaaaattcacctgtattttccttgctattattttatgctgaaaaagccggtttgtgccttgcctgaaaaggaaatgtctgacagaaacagtccttatctcggtagatccggctgcgggaacagaaatctattgctgtacatactccgcggataatggaaagtacggttttgttgtaattgcatatgaggggttcggggctgtctaagatatgccttgaggaaacactctatccttttgattggaaggaaaatatagaggacgtaatggaagaactgaagaaaacagatatcgatctgtccacggcctcggccgtaagggagaggattaatgacggaaagcaggggataacggaagctgtccgcattaccgataggaaaggaaacacctgcctgcttctttttgatgcaaagggagtagctctgtctgaacaaaaatagcagcatagaaaaaagggaaaagtacgccgcgaaggagtagcttttcccttttttgaatggctgttattcagcagaacttttttccctgtttcctttgtcaaaaaatgactcgcgggtatcggtatcttcctcactctcttcatcagaatcgacaggctcgggcagtgtcatcagcacctttgtgatccggttttgctggacgtcctccacgcgcagggtgatgccgtcttgcgttgtcacctcatcgccgggaaccggcatacggtcgagaatttctataataataccgccgatagaatcataatcttcactttccagctccgtatcaagggcatcgttgatatcatccagtttcatgccgccctccaccagatactgccgttctccgatttcctgaatgagttcatcctcgtcggcatcgtattcatcccggatttcacctacgatttcctccagaagatcctcgagggtgatcatgccggcacaggagccgtattcgttcagcacaaaggctacattaaaacgcttttccctcatttctatcatcagatcggctgtttttttgtactcataagtataataggcatccctgaggatatcggtaatacggaaattttcccgttcctccaccaggataaaatccttgatattcacaaggccgataatattatcgttatcatcctgatacacaggaatacgggtatacatatatttcttaaatacgccgagaagctcttcataaccggcttccacgcttatagtgctcatatcgatacggggaatcatgatatccttggcaaccgcatcgctgaaatcaaacacattgtaaatcatttcccgttcttcggattcaatgatgccgtcttcatggctgacatccacgtaagtctttaaatcggattctgttatctgatcttttttcttattgggatccacatgcagaagtatcatgatccccatggataggcgatctacaataaaaatcagcggagtcaacagcttcatcagtgtataaattacccgggcataggccagggatactttttctgaattcagggtagcggcatttttggggacgatttcaccgcagagcagaaggacaagagtaagtacgccggttgcgatgctgaccgcataatttccccagattttaatggccatggtagtggtgagggcggaagcggacagattgaccacattgttgccgatgagaatagagctcagcatcttgctgtaattatccagaatcttctgaaggattatggcacgcttgtttccctcttcaatcagcgtacgcacacgcacccggttaacggtggtgagggcagtctccgcagaagaaaagaatgccgaaagggcaatgagaattaccagaaaaataaattgtaggaccgacgatgaatccacgtaaaatttcactcctttttcatgttgtgcccccggtataaaccgaagacggatttttcttaagtatataactgtaataataggaatcttacaaaaatacagccgaaatgtcaagtaaaacagggttctgccccgccggaattccctgccctgccttttgggcgcggctctgcaaggttcctgtcagggcacactctcgctcggataactacgcagcggtactaaggttgcacagaacgcaacctaaggaccggcgtatttatacggcccatacaggaatccttgcagagccgcgcccaaaaggcagggcagggaattccggcggggcagaaccgtaagaccggcgataccgggccgtgagttatagaatcataagaaggaattccattttttcaaagataacaggtataaaatacaggcggacaggaatatacatgtgtcaaggaggagcggatatggataaaaaagaaatcaggagctcgaatatattatttctgctgaaatgcctgttgttttcctacatacttaccggaggatttctgctgctgctggcattgttcctttacaaatttcagctgtctgaaaaagtagtatccattgccatcatcggtatctatgtggtagccgtattttttgcgggcttcatgacgggaaaaagaatgggaagcaaaaaatttctgtgggggcttgcggtcggactggcttattttgcggttatggctctggtatcgtttgcggctaaccatggatttaaggatttggggacacattttttcaccacgctggccatatgcgccgcggggggaatgctgggaggaatgctcagctagaagcgcccggaaggcctgagaaggcttgtttcagggtttatacttttttaataaaaatactttccctgaataaaaaactatgatatactagcttagacaatgacgtccgggtatcggacggtattctgtccagataaagagatgccgttcggacggttttctcatgtaaggaggcaatggtatgaaacatattaagacactgaccacaagagacttaaaagaatccatgaaaaagggcggctgcggcgaatgtcagacatcctgccagtcagcatgcaagacatcctgtacagtaggaaaccagagctgcgagaagatgaaataggcagattctgaagaaaccgaataaggtttttataagcagcgatacctatcgctgcttattatacgtgaagatgatcggcaggggccaaaggcctttcctgccggcttctgtgcgttatcagaaagagagcagaaaggaagttttccagtgatacaccagtacaaaaacaacggctacaacatcgtaatggatgtgaacagcggaagcgtacatgttgtggacgattgtgtctatgatgtgataccacggattgaagaatgcattaataagggcgtaaaggaaaaggacggaattctggatgcgctgaaggcggagaaaatgatttctccggagaattgtccctatacagagagtgagctggaagaggctgtggaggaaatcctggagctttatcaggcaggacagctgtatacggatgatatttatgaaaattatatcggggcctttaaggacaggcagacggtggtaaaggctctttgcctgcatatcgcccatgactgcaaccttgcatgccggtactgcttcgcagaagagggagaataccacggcagaagggcgctgatgagctttgaagtgggaaagaaggccctggattttctggttgccaattccggtaacagggtgaatcttgaggtggacttttttggcggagagccgctgatgaactggcaggtggttaaggatctggtagcttacggaagaagcctggaagagcctcaccacaagaagttccgctttacgcttaccaccaacgggattcttctgaatgatgaaatccaggaatttgtaaataaagaaatgtccaatgtggttctcagtatagacgggcgcaaggaaataaatgacaaaatgcgtccccacagaggcgggcagggcagctacgaggaaatcgtacccaaattccaaaaactggcggagagcagggagcagttcaattattatgtgagagggacttttacccataataatctggatttcggtgaagatgtcaagcatctggcggatctgggctttcagcagatttccgtggagccggtggtggcggagccctctgaggattatgcgctcagagaagaggatctgcccgtgctgctggaagaatacgacaggcttgcagcggagctgattaagcggcagaaagaagggaagggcgttaacttcttccactttatgattgatttaagcggcggcccctgcgtggcaaagcgtttatcgggctgcggttcaggaacggaatacctggcagtgactccctggggagatttttatccatgccatcagttcgtggggaaggaagaattcctcatgggaaatgtggatacgggaattgtcaggacagatatacgggatgaattcaaaggctgtaatgtgtatgccaaagacaaatgtaagaactgcttcgccaaattttactgcagcggcggctgcgcggccaattcttataatttcaccggcggcatcaacggaacgtatgacttgggctgtgaactccagaaaaagcgcattgaatgtgcaattatgataaaagcggcactggccgactagaatgaaggagataagaagcaatgaacaagaaaaaaggtattttaaccctgattgcgttcatcgtcatattggccggattgggctatgtgtccgttttcggtgttggcgagaataaatcaggctccgcgtccagagttaagcagggccttgacctggcaggcggtgtcagtattacttatcaggtagtgggagaggaagaacccagctcggccgacatgagtgatacgatttacaagctgcagaagcgtgtggaaaactattccacggaagctcaggtgtatcaggaaggctccgaccggatcaatattgaaatccccggtgtttctgatgccaatgcggtattggaagagctgggcaagcccggttccctgtctttccaggattccgcaggcaatgtagtgctggaaggtacggatgtttcggatgcacaggcgggttatcagaccaattccctgggaaatcaggagcctgtggttcagctgactctgacggaaaacggaaaaatcaaatttgcggaggccactaaaaaggcggctcccacgcgtgacatcatttacattatttatgatggctccgttgtaagcgctcctgctgtccagtcggagattacagacggttctgccgtaattaccggtatggggtcttttgaagaagcggaaacccttgcttccactatccgtatcggcggtctgaagctgcagctggaagagctgcgctccaacgtggtcggcgcccagcttggttccgaagcgattaaccgcagccttacggccggcgcaatcggtatggctattgtcatggtgttcatgattgccgtttactggatccccggtgtggcgagctcactggcgctgtgcatgtacgtagtgctgatgatcctgctgctcaacggctttgaaatcacccttacccttcccggtatcgcaggtatcatcctgtcaatcggtatggcggttgatgccaacgttattatcttcgcacgtatccgcgaagaaattgccacgggcaagacggtgaagtcttctattaaaatcggtttccagaaggctctttcagccattctggatggtaatattacaacacttattgcggctgccgtgctgggctttatgggctccggtaccataaagggcttcgcacagacgctggcgcttggtatcgtgatttccatgtttaccgctctggtagtcaccagattgattctgaatgccttctatgcggtagggcttcagagtgaaaagctttttggacgtacaagagacagaaagcctgtaaatttcctttccaggaaggccgtattttttgcgatttccatcgtcctcattgtcgcaggctttgtattcatgggtgtcaataagggaagaacaggacagattcttaactacagccttgagttcatgggcggaacttccaccaacgtgtccttcaatgagaacctgtctattgaagacattgatgcgaacgtagttcctatgatagaaaaaattaccggtgacggtaatgtccagacacagaaggttcagggatcaaatgaggtaatcttcaagacaagaactctgaatgtggatgaaagagaagaactgaataagattatggaagagaacttcggcgtggataaggagaagatcactgcggaaaccatcagttcaaccatcagcggggaaatgagaagagaagcggtcatcgcagtagtcattgccaccgtatgtatgctgatatatatctggttccgtttcaaggatatccgctttggcgccagcgcagttgcggcattgattcatgatgtactggtggtactggcgttctatgcggcagtgcgtgtatcggtaggcagtacctttatagcatgtatgcttactattgtaggttattccattaatgctaccattgttatctttgaccgtatccgtgaaaatattggcctggaaggaaaaagcgatctgtcaggtctggtaaacaagagtattacccagacactcaccagaagtattttcacctccctgacaaccttcattatggttgccgtgctgtatattctgggtgtaagctctatccgtgaattcgcgctgcctctgatggttggtattatctgcggaacctattcttccgtatgtattacaggcgctttgtggtttgtccttcgtacgaaaatcaaaggaaaaaccaagggagcggcagtaaaagcaaagtccagataaaagttaactgatgaaaaagcgttctgctcagccaggacgcttttttaccgcgtcagttcgagtatggactgtgtgaaaaagggacaaatatctttttatgctgctgcagatacaaaggagttaatatatggcaaaatggtttgtcacggctaaaagggcggactttacaaaaataggggaaacattcggcataagcccggtgctggccaggatcatccgcaacagagatattattgaagaggaagaaatccgcaaatatcttcagggaaccatagaggatatgtatgatcccggcctgcttaaggacatggaccgtacggtggaaatcctgctggataaaatcagccggcggaaaccgatccggatcatcggggattatgatgcggacggaatctgctctacctttattcttcataaaggactgctgcaggcgggcgctgctgcggacacggcgatacctcaccgcatgaaggacggttacggcctgaatgagcatctggtggaggatgccttccagtcagggatagatactatcattacctgtgacaacggcatcgcggcagaaccccagataaggctggctaaggaaaaagggatgacggtgattgtgaccgatcaccatgaggttccttatgaggaaacagatggggaacggaaatacatactgcctcctgccgatgcggtgattgatcccaagcaggaaggggatgcatatccttataaagggatttgcggcgcggtggtggcctataaggtaatggaagccctttaccggaggctggagcttacacagaaggaaaagcctctgctggaagaacttctggaaatggccgcttttgccacggtatgtgacgttatggagcttctggatgaaaacagggttattgtaaaattcgggctgtcccatatgaaaaacacctccaaccagggactgagggcactgatggaggtaaatggcatagataagggaaaactgtccgcttatcatatcggttttgttatgggcccctgtctgaacgccacagggcgtctggatacggcggtcagggctctgcagcttctggaggaagaagaacgggcggaagccgtccgcatcgcctctgatttgaagcagctgaatgacagccgtaaggaaatgactgatatttatgtgaaacaggctgtacgttccgtggaagagaacgggctcatgcaggatcgggtgctggtaatctatcttcccgactgccatgaaagccttgcaggtataattgcaggcagaataagggaaaaatactataagccggtatttgtgctgaccaggggagaagaaggcgtaaaaggcagcggccgttccatagaggcctatcatatgtacgaggaaatgaccagagtcaggcatcttttcaccaagtacggcggccacaaaatggcggcgggactctccctggaggaaaaggatgttgaagatttccgcagggagatcaacgaggtatgcacgctgacggagagcgatatggaggaacggatccatatagatgtccctatgccggtatcccacgtttccatggaattcgtaaaggagctggagcttctggagcctttcggaaacgggaaccccaagcctgtttttgcccataaggatttgaccttcctgtcggccaggattctgggaaaaaacgggaatgccatacgtttcaccgtgctggatgattgccggaacaaatgggaaatgatggccttcggagatcccgaacccatgaacgactatatgaaaaacaagttcggccaggaagcggtggaacggctttatctgggaaaaagccaggatatcaggctgtcggtcacgtattatccatccatcaatacctaccaggggaataccaaacttcaattggtgatgcagcagtatcagtaatatgataaaatatataggtaaaggtcactgttcagcgcctcaccgccagttgggaatgcgtcccgggatatggctgctctttgccctgccgaatccccggccatacagaggtccttaaaggggacgctttcgctcggataaccacgcaacggtactaaggctgcaaatggaagcaaagcattccaaggacgcagcctaaggaccggcgtgtttataacgccccttacaggatcctctgtatggccggggattcggcagggcaaagggcagccatgtcccgggacacattcccaactggcggtgaggcgctgaacagtgacaagtaaataaaattagcaattaacagaacaggggactatttatgattttaacagtgacgctgaatccggcagttgataagacatacagaacaggtgagcttttccccggaagagtgaaccggatgcgttccgttgataatataccgggcggcaagggaataaatgtgagtaaaatactccgtcagtacgattacgaagtgacggcaaccggttttctgggaggctatcagggaaggtggatggaagaccagctggacaggctgaaaatccgcagcgcttttgtacaggtggatggagaaaccaggaccagcatgaatattgtggctgataacggttatgtgacagaaatactggagccgggtcctcacatcagtgatacgcagctgaaggaattcatgcagaagttcgcctcattggcggaagaaagcggtctggtcatactttccggcagcgcggcgccggggattcccacagatatttatgccaggcttatcctgagcgcttcctccatgggaaaacaggtgattctggataccagcggtgaattgctgaaagagggtgtaaaggcggcgccttccgttgtcaagcccaacagaaaggaactggaatatattatcggccgcaggctgcaggatatgaatgacataaaggatgcatcctcagttcttctttccgatggggtgggccttgtaattgtttccctgggcgataaagggctgctgctggcagggaagggaagatgcctgtatgcaagggtacccagagtaaccgcactgaatacggtgggctgcggggacagcgtggtggcctctcttgcgatgtccatgacatccggcgcggatatagaggaaatgctccgaaaagctgcggctgtttcggcagccaacgctacgacgctggaaagcggcaacgttcctctgaagctggcggaggagatactccgggatattcatattgaggaaatttagcagctgtgaagctcctgagaaaaatttaaaaagacaagataaaaaggctcctgttaacaggggcctttttatcttatcttttatgaggggggagataggtgttgttcatctatctgagatatatcataaccggaaattgtgacaggaatatgtccattttcaaaaaatgaaataaaatttataaagtgtttctttataatccattaaagaaatcgtacgatcaacatttttccatgatctgttcattaggataacagggagaggatatctgattattgaggaggaaaagggatattgctataattatattgagaacaaagcaactgtggaggtactggacagctgcgaaataaattgctccggatcaggaggttcgccatgaaaaaaatgtatatcgttaccggcgcggacggacatctggggagtactgtcgtccgtatgctggagcaggaagattgtctggtgagggggctgattctgcctggtgaagagggtgtgaatcggggaaatgtggtttattacagaggggatgtgcgcaggagggaaacgctgctgtcgctttttgaaaatacagacgatatggaagtgactgtgatccataccgccggaattatcgatatatcagggaaggtgactcccctggtatatgatgtgaatgtaaacggaacgaaaacaattgccgggctcagcctggaaaaacaggtaaaaagatttgtctatgtcagttccgtccatgcgatcccggagaatggggattacggcgtgatgaaagaggttacggaattttcggaaaaaacggttacgggaggatatgccaaaaccaaggcggaagccaccagggcggtcatggccctggttaagctgggcctcgatgcggtggtagtccatccatctggtatattggggccctttggcggtacgggaaattatctggtacagctggtaaatgattatattatggggcggcttccggcatgtgtaaagggcggttatgattttgtggatgtaagggacgtggcaaaaggctgcctcctggcggcttccaaaggaaggaaaggggaatgctatattctttccaaccgtcattacgaaatcaaggaggtgctggccatggcccggaaggtctgtaaatgcaggagtgtgccggtgcttcccatgtggatggccagggccgcggcccctcttcttgcaggttatgcgaaatgcaggaagaaacgtccgctgtataccagatattccctctatacgcttaaaagcaatgaccgtttttcccacgataaggcaacaaaagagctgggctacagtccgcgtgatctgatgcagacgataaaggatacggtacaatggttaagggaagggaagaaacagatatgcttggattaaatttcagttccagaaaggacggtaactgcggggatttccttcagttcctcaaacagcagacgaaacagaggtttgtggtaaaatggattcatgattttgcctttgacggctgcggcccctgttcctatgaatgcatacagggaagctgtttgaaaaaggatggcttttctgatctgatggcatggatggacagagaagaggagtacttttttgtgatgcctttgtataatggaaatctcacgtcggctttttaccgtctgctggaacgcctttcccccaggcttcatgaagaggcggaggaaaggcggttctggaaaaagacccggattcttctcataggaaatccgggacacgggctggaatgcgccttacatacactggaaggtttataccggaatgccggacagaaaccggaaattcttgtattttcggctatggattacgggatgaaggccgccagggacaggctgattgaggaaaaggaggtaagaagaaagctgataaaagcggccggagaagcggactagacaggaagtccgggattctgacatgagaatagaaaacgaaaaagctgccagcggcatataccgtactgacagcttttcgttttcttatgagggggagatagttttgagttgtttaactatctgagattataatacaggaaatttgtgacgggaatgtgtacattttagaaaaagaaaataaaaagtcttaaggttttctttagaaaaagggaagaagatcttgcggcggggggagaacaaaaagtcaggagctgccgtctgctgtctggcgtcctgtgtcccggtcttcgttccccagtgtgcggcggcgttccgggcccggagggaaatatctcagccgcaggtcctgccgcgtcgggcattgcgatgagcccgagggcggcaaatgggacaggtgaggctgtcccatttgcccggtctcatctccatgacgcagaaaggatctgtggctgagatatttccccccgggcccggaacgccgccgcacactggggaacgaagaccgggacacaggacgcggacagcagacggcagctcctgacttttttagatgaagggaggaaggggtgaaagggctatttagggggcggtctgctatgcctcggcgggggtttctccggatttgaagatgcggttgagcatgatgactgatgcgatggagaggacgagttcggcgacgaactgggcataggggaggccgtatagtgggaagaggaagttcagtatgtacagggcgggaatttcgaggaggattttgcggaggatggcaaatgccagtgcggatcggccgtggcctacggcctggaatacgcctacggcgataaaatccatgcagaggaagggcaggcagaggcagaagccgcggaggaatcgggttccgaaggcgataacatccgcatttttcataaaggaattgatgatggggccggctccgacggtgaagaggatcaggacggctgccatcagggggacaatggttttgattgtgaacatgatggattctttcatgcgttttcggttgttgctggcatagttgtagctgatcaggggcataacaccctgggaaaatcctatggctacctggagggggaccatatttactttctgggcgatgcccatggcggctacggcatgggggccgaagggggaggtgaagttgtttaagatggtcataccggttacgttgagcagattttggatggaggcggggattccgacaccgcagattcccagtacgattccttttcgaaaaccgaattttttcggggagatgcatactacggtggtttttctgcgtacgtacagcaggatgaagaaatagcagcatgccacgcagtttgagaggaaggtggcaaggcctgctcctgcggctcccatgttaaggccccaggggagaatgaaaatggggtcaagaattatgtttaggaggcatccgctcatggtaccgaggctggcgtggagtgaggcgccctccgcacggaccatataggccattacgacgttcaatatggcaggggcggctccgcatataactgtccagcgcagatagcccagtgtcgcttccgctgtattggtatctgccccaaggacggtgagcaggggattttgaagagcaaagcataagaaggagaataagaaaccggaaagcagtgagcagtagaatccgaaggcggagcttcggctgacggtatcgtagtctttgcgtcccagcgcccggctcatcatgctggagcttccgacgccgaagaggttattgacggcgttgaaggccaggagaaccggggctgccagtgttaccgccgcattttgtacagggttgtttagcattcctacaaagtaagtgtcggccaggttatagattaccatgaccagtgagctgagtacggtgggaatcgacaattgcattacggcctttgggatcggcatctcctcgaataattgtgttttctgattatcggccatttccttgtttcctcccatgtaaaagtgagacatctgcgaaatgtctgcgcgtatttccttttattatagcaaagggaagttgtgaaaacaagacggacctcgggagcgggtgcagctaaaaaacatcggtgccgcccctgccctgctgtcccctcccgcctgtgtaccctggctgtgtctgccccgctgccctttgcgcccctcctctgctgccacagccctgcaaggttccttacaggggacgcttccgctcggataatcacgcagcggtactaaggctgcaaaaggacgcagcctaaggaccggcgtgcttatgacgccccttacaggaatccttgcagggctgtggcggcagaggaggggcgcaaagggcagcggggcagatacagccagggtacacaggcgggaggggacagcagggcaggggcggcaccgatgttttttagctgcacccgctcagaatccaagaacagcctgcaggaaagtcccctggctcagatggtattcatttttttatctgcggcattcagggcttggtggaatttatacggtcggaatctacacaaaagtattaatagaagtatttataaggatatgttaatataaataaatggaaatacgataatcggaaaagcacaggccatggagatggggttcgtggtatttaaagtaaaaagttagggatgaggtagttaagatgccattagctaaaaagaagtacaaatcatatgatgcactaattctggcgctgaaggcgtctcctgtctgtacggtattgaaatttttgctgtcagttacgcagtctataatgcagacagcggtgatggctgtggctacggctaattttgtggatacggcggctgaaatacttaatcatgtgcggccgcagaacgatatctatctgccgctggttttattgcttgccgcgctgggagtggtaaatacgattggagcggttgcgaagctggccggcgccagggtcagtgtgaagcttcagcggaaattaaagccgtctttaattaaggtttatgcggcatttgaatataagcatattgagaatgcagagagttgggaattgatctcacgtgtaaccagggatcctgtgaaatcgattatggatggggtggatgcctttatacagtttattcagatcatagtatctgtttcctctgtttttcttttgattgtgacacaggtgtggtgggctgcattgatcattctagccttttcggtgcctatgttccgggtatcgatgcgcgccggaaaaaagaattatcaggctgagtgtgaagcggaaaaattcaacaggcgtaccgattatctgggagaagtgctgaccgggcgggataatgtggacgagcgtacgttgtttgattacagtgacgaggttaaccgtaagtggcaggagcagtacgaggcgggcagaaaaatacaggttaaggttacggctaaaatgttcctgattacaaaaggttccagcatgattctggctctgatttcactgctggtggcgctgacattgattgggccggtagtgcatggacagatgacagcaggtatgtttatgggtatcataagcgctgtgttcggtatgatacaaaaattgggcttccagatgtcgcgttcccttgagaatatttcgcgggtgggcgaatatatgaaggatttgaccgcatttgtttcgctgagcgaagagaaggatgcgttgacggaaccggatgctgaaccgatagccattgatttgctggagttccgtaatgtgcgcttccgatatcccagtggagacagatatattcttgacggattgtcctttaagctggaagccggacgtcattatgcttttgtcggtaaaaacggcgcgggaaagacaacgattaccaagctgttaaccggactgtatccggaatatgaaggggaaatactgataaatgggacagagctgagagagtattccgccggtgcggtgaaagcgatgttttccgtcgtgtatcaggattttgccaaatattatattggaatgaaggataacatagcgctcggcaatatacatacaaaaggaaaagaaagagaagcggctcatctggccgggctggacgaagccattgacaggctgagggatggtatcgatacgccgctggggaaaattctgaaggatggacaggatatttcgggcgggcagtggcagcgtgttgcgattgcgagatcgcttatcagccaggctcctgtcagaattcttgacgagccgacatcggcgcttgaccctatcagtgagagtctgctttacagtgaatttgagaaactgatggatgggaagacgactgtatttatcagccaccgtctcggttctaccaagctggcagatgaaatactggtcattgatgcgggaaaagttacagagcgggggacacatgaagcgctgatggccaaaaaagggcggtatgcagagatgtttgagacgcagagggagtggtatcaatgagtgcggaaaagaaaaagtacaatttagtaacagtcatactgcggattatccctatacagtttaggtctgcgccatggaactgtttgattgagaatacactgggaatcatgaatggactgtcgttcacgctggcagtagtggcaacacagcgtctttttgatgtgatttccaaagcggctgccggaaaagcaggtttttgggattgtgtgattcccctgctcctgttggcggcggttacgtttgggcagcagatcattaacggcgttcagaattttcatgggatcggcatccttctgccgaaatcctctggaaggcttactgcattgattcacaaaaaactcaggcgtatcgatcctgtatattttgaggataccgatttcctggatgatcttaacaaagcgagggaaggcatccgggcaattaccatgttctgcatgattgtatttgtctgcgtgagtttttacggggtttattttttgtcaatcggagtatacctgttccggctgaaacccatgctgatcataacactgcttcttgcatttatccctgctctgtcggcacaggccgtcaatgtacgggtatttaccaggctggaagaacagagcgctccgctcaggcgggaatatgagtattatcaaaaagcgatctgcgacagggagtattttaaggaaacccgtatcctgggcgcattttccttcttctatcatttatttgaagataccatgaaactgctgacggaaaaggtatggaaagcggaacggaaaacggcattgcttcagcttttattggattttacagcatttgtgggaatggccctttcggcctacatgctgtttagggcaacgatgtcgggagagattacggtcgggatgttcgcggctgtgtttgcggcgctggggcagatatttgccattatgcaggagattgtaacgcagcatatcggcaatatgaacagggatatggggaaggtggtcaatttcatacggctgcttgatatgccggagcgtacaggcacagaaggagaaacggattttgccagaggtgttgcggcaaaggacatcagctttacttaccccggcagagataaacctgctataaagaatgtatcgttggaaatcgcagagggggagacgattgccattgtcggagaaaacggcgccgggaaaagtacgcttgtacgtctgctgaccggtatttaccgtccgtcggagggcaaggtactcatcggcggactggacacggctgtggcttcccctgcctccgtttataagggcgtatcgggtgtgttccaaaaataccagcgttataaaatgactcttaaggaaaatgtggctatcagtgatgtttcagccgaggccagagctgaaaagattcattccgtactgtccgaggcagactttgagatgggcgatatcaaacttgataacatgctgtcgccggagttcggcgggattgatttatcaggagggcagtggcagcggattgcaatcgcccgcgggctgtaccgggtaaacggtttcatcgtattggatgaacccacatccgctatcgacccgattgaagaaacaaagatttacaagcagtttgaacagctggcaaaagggaaatgtgcggtagtggtaacccatcgtcttggctctgctaaactggcgcatcgtattgtagtcatggatggcggtgagattgttgatatcgggacgcatgaggaattgatgtcccatccgggcaaatatgcgacgatgtgggagaaacaggctcagtggtatgaacgggctgaagattgtgttcctgcacagcttcctgtgtaaaatgcaggcaaatggcttgctcagcgcgatgaggaaaaggtgatgtttgaaatttcccattaattattttttataaacttggaggaaactgtatggaactgcggcttgaaaatgaaaaagattactttgaagtggaaaatctgacaagagaagccttctgggatgtataccgtccgggatgcagtgaacatcttgtccttaataaattgcggcaagcggattctttcatcaaagatttggattatgttttgattgaggatggaaagatcgtcgggaatatagtctacacgaaaatgtttaccggcacagaacggaaaatgagcgatgaagtgattgcatttggccccataagtgttcatccggatttccagagaaaaggcctgggaaagaaattgatagaatataccctggataaagcaaaatgtttgggatataaagcagtactcattacaggagataataattattataatccgctgggctttgaatccgcctgcaggtatcatgtttatctgccggggacatcggaggatgatgaagcggcattttttatggcaaaggaattggaagaagggtatctcggtaataacagcgggatatatgattttgatacttgctttaatgtcagcgaagaggaactggaaatatttgatcggaagtttcctgagaaatcgaaacgagaagcgaaggaaacggatttggcataaccggaggactccggtcgtacagccttccttttggcgtgaaatcaaaataataggcactcggaatcgtgagcttgccggctaagatccaccattatgttatgatgagagaagtttttttatctaaatcgtttagggattatcatgtttcgcccgttaaacaggaataaaaaagctccaagcaagtgatcaatttctgtataatatgaccgatccccgtacattcttcagcgcttggaatgccatcgtcctctccagaggagatatccgggattacaagctgctaacggaaccatataagatgtttcagcccctctatcacggaagtggtgtaataggacctgaccgtgtcactttgcagagcatattttaactcttcggttttgtctatatctaaattaatctatgcagggcagatgggctattccatcccgccctcgcttgcgggatggtactgtttctgtgtcaggcagcttcggatctggctcatcaggagagcgcaggttctggcgcgctccgcatactttatcccggttttcccaaatatcgtctacactttagaatagctgacgggcggagaaaaaggccctctatggcaatgtatcacgcggcccagcgggatatgcgggaggccttggccttcaagacggggagcacggcttccggcagggataaggaacaggcgcgatagcatcggtgacgtagccatcacttctgtataaaatgtccagaagcggcgggggtggagcctagccctgcttgccggtagtgcgtatctgaaaatttctagtcttagggcagtaatcgcagatcatccgaaggaagtctgccaaatacagccttatatgttttggtaaaataggagtcattgttataaccgcttaaagcagcactttcactgacgctgtgatttccctccagcagcaggtttctcgcatgctggcatttgaggaaatttacatattgaataatggtattacctgtcattttcttaaatgaatgacacagataaaacttactgtaaccggtgtcagcgcacaattcatcgatggtaatgcgttcaagaaaatgctcacgcagatacgaaattatcttttttactgcctgtacctgctgattgtccgaagatttccgttcggtcgtattatcaagatactcccgcattaaaaggaggacaatagaaatgatttctatctgtacagcctgtttgtaataagcatcctttcgttccatttccgcgataattcgtctgatggatgcttccattcgggcatcctttatctttttttaaaaacaaacagatgtggctcaagccccagggggctgtatagtgcgctccccaaatcaagggaatacatgcggcattcggattccgtaaaaccatcgtgaatatctccggaattgacaatcgcaatgtctccctcttccacgaaaatgcggtcgctgccagaaattacccagccctgcccgtactcacagtagacgacctcaatacagtcgtgccagtggagatacgtatcgtcaggatgactggcagagagtaccctgcatccaaaaataagcggaaaatccgcatcaagattattgtgtaattcatacttcatttgttatcgcacatcctcctgcagagcaatatcgtgttatattgtggcaatatcatttctttttattccataatttctagtatataatggtattgaattatttgtcaaatgatattagcacggacaatataagagcaatataagagtggttttttgtagcggaatttccctgttgctgaagtgcagccgggaagcgtcagagttcattatcaggagtaaacacatatgctgcaggagaaggataaggctttttacagcagagcggccaatatagcattgcccattctggcccaggggctgttaacctatttagtgggttttattgacaatatcatggtgggacagattggaacggaggccatgtcgggagtggctatcgggaaccaactgcattttgtctacgccacctgccttttagggattgtcgctggagggagcgtgtttggcgcacaattttatggcagtagggatcggaatggttttagagagtcgtttcggtttcgtttccttgtctgtctggctttatccgtcattgcgttttttatcctgcttgtgtttggaaaaagatttatttccctttttttatatacaagaggggatggaacggacgcggccatgaccctgctgtacggaaagcagtatttgactattttgttgttcggtatggctccttatgcgctgacgcaggtatacgcaagcgccatgaaggatatgggtaaaacgctgatacctatgattgccagtatcgccgcaattttgtccaataccgccctgaattatctgctgattttcggtacgtttggctttcccaggttaggagtaaagggtgcggcgattgccacggtcatatccagactgatagagcttttcattatcctgtttgcagtatacaagccggaaagcgcttttggggccttacaccgcgcatttggaaagcacaggaagaaaactgcattaagcagacggattttagttaagggcctgccgcttatggtcaatgaatttttttggtcaatcggaacggtcattatgctgcaatgctactctttcagggggattcaggtggtggcgggattaaacatcgctacgtccatgtataacatctttacggtagtatatcagtctgtgggcggtacggtggcaattatgatgggacagttaattggcgcaggcaaaatgcaagaggcaaaagaagcgaataagaaattgttttccattgctgtccggttgagcgttatctgcgggattgcgttgtttgctgccgccccctttattccacggctatatgccaccaccccggcagtaaaagaccttgcggcacagcttatgcgcattttggcattgtgcctgccgatctcctgttttactcatgttgccttttttacaatacgtgcaggaggaaaaacgattgtcacgtttttgtatgatagtttaaatctttggattatcaatatcccgttggccttctgcctgacaagatatacggatatgcccattgtgcctgtttattttatatgtcaaatggcagagatcgtgaagctcattgccggatatattctggtgaaaaagggtgtgtggctgaataatattgtccgggaaaatcagtaagacaataggaaagcataggaagatggcaccctattttgaaaataaattgtgggattacaaagatggaggtctaaaaagatggttctaaaaattatattgatattattatttattgttatatttttaggtatgattttatttatatctaaaatttatcagttgaaaaagttaggaaaaatgacctctagtgatgtaatagattatgtaacaaaagatgatgatgaaattaaaatatctgttgcaataattaaagatggcgaggtaacgtatcaagtttatgggaagaatggaaaaacacttgatgatacaaagtatgattatgagattggctcaataagtaaaacttttgtaggtttgatgctttcaaaagccatagaagataacaaaataaacttaaattcatctattagtgaatatttggcccttgataaagacaagtattatccaacaatagagcgattgataactcatacctctggttataaaagccattattttaataaacaaagggtaagtaattatttccgccaaaataatgatttctatggtattcataaaaacgatattctgaataaggttaaaaatatagtgcttgaagataaggattataaattcaaatattcaaatttcggaatagctgtaatagggctggttttagaacaggtttacgatgaagatttcgttactcttatgaatgactttattgaaaatgatttaaacctcaagaatacgaaagttgcattaagcacagggaatttaagtggttattggaattggaaagaagatgatggctacattccggcaggagcaattatttctaacattgaagatatgatacaataccttaaatactatatgaattgcgaagataactatattagtaacacttatgccgaactaaaatcaataaatgccaacaattctatttatgaaaaaatgaatattagaatggataaagttggaatgacgtggttgatagacgaaaaaaataatattatttggcacaatggtggtacaagtaattttaatagttatttcgcgtttaacaaaagtaaaaaaattggtgttgttgttcttgggaatacttctcctattaagaaagtgcctatgacagtcattggtgtagatttaatgaatgaattaaaatctacttcatagaaaaataaaaatttgcaaaggtggtgtattatgaaaaatattttaattcatgggttaggtcaaaatcataaaagttgggatgaaaccatcaaatatttagagatagttaatatagatgttctttgtcctgcactctttaaaatatcaagtagcgatagcagtgattatcaaaacatatttgctgctttctctgatttttgcaacaatcaggaaggaaaactgaatttatgtgggctttcattaggtggaatactggcattggattatgtgaaaaagtatccagaaaaggtaaactctattattatcattggaacaccttatgatattccaaaagcccttttcaaaatacaaagtatgatatttcactttatgccaaattcacaatttgatgatatgggctgttcaaaaaaagattttattactttagtaaactcaatgagcgatcataacataaaggatggtttggataaaattaattgccagagcctaatattgtgtggaagtaaagataaagcgaatatgaaaagtgctgaacaaattagcaatagtataagaaaaagtgaatttaaaatagtcaaagattcttcccatgaggttaatgttgataacccaaaggaacttgcacacataatttatgatttttggaagggatttcggtagcacaaattccacttatttgtttaattacatcaatcttttatgacggcgatacgccgtgcggttttatttatatggctgctaaagatgatttagcctttattatgttttttgcagtcgacaagaatattcgttcaaaagggtatgggagtgaaattttaagcaaagtccagtccttatatccagataataaaattattgtatccattgacatatgtgatatggatgctgaaaacatcgatgataggatcagaagaaaacatttttctacgtttttaaggaagtgcagcaacggtgccatgaaacttaagatatggaaaggataactttccgtttatcaggttgtgaaagcgggctttggaggtttagcaatgaagaaactatataatattttgaaaatagtattgttgtgcttcatcggagtttttatagggagcagtatttatcagtaccatgattacaaaacacaccctgatatatacgtgtcgcaatccgctccgtggtatgtgagtattgagattcggggaatacttacagccattattgttatggctattcttataacaatgtggattataaaaaagaaaattaagtgaattaattctagcttataaattagagctgcttctggacattttgtacagaagtgacaggggcagcaatcggaaaggaggactaaactatgaagtggaaaaaggaatctcttgtttcatcaatgctatttgcgataggtgcggtaatttggatcattactattccccaaacctacaaccataagggaatctttgatattttgctagtgctgcattgttgctgtgcattattgtttagtgcggcggctatcgctttttttattaagtatagatgtagcaagcggaataaggacgataaataacttttagtgtccagaggtggcgattggctgataggagtaaagacgaattaattaaaatcacaagagaatacactgcaaatattatatcggcggcagagcagtatatcaaaatatttagagaataccttaacaacaccataacagaggaacaacttatagatagcgttgctcctctaaatattgaaatttaaaatggctttcggacgggcgggtgaccttatagcgaaaacacccacttcggcggagactggaatattccttttgtgccgatagtgattatcctgttgctggtttctgtgtcctgtattttagctgtttatgtatcagcgaagcggattcgcaatatgccgattaccgcaacaattaacgggctataatattttccttttaattaagacggctaagagaaatcaaggccgtcttattttttgagtttttccaacaaaattgtaatcttacagtaaggttggcgtgctatccattccacatcaaaacaataatgtattattgctcacgggaatgatagtggcattttttggtatctttggctgtaatccggcttcttatgcgctttatcaaaaaacacaactttaaaatcttcggctggtatcgaattggccttgctgtggttgcagcggcttacttcggttttgccgcattgatacgaataccgacgaaggccggagtttaagaacagaaagaaaggctgcgcgcctatgccgagcaacagcattatgtggttattctttccacctccagagcgaatagaaaccattcacagagaaatcaacatattccttatgatctgcttgtataaattcaattgttgaacccaatcggccttcttcgttttcagagtaaccacgcatttccatatattcaatcagtaaattactagaagaagttggtttagcaataattaccttaggataatcttgtatttctgcatattcggtatcggtaaattgtatttgatatagtccacttattactgaaaataaatttgtcacaccaaatttactcatagttaaaaatattgatattcctaccaatacgattaaagtagataatatcaataccactattttagccctttttttcatatgattacttcctcataaagtataaatagaccgtactacccttaatccatctaaggtgaccaacaaaattattatatactatcgccttgtcctgtcaaggtggctaagtgaagcagacggagattttgccgtatttttgtggcgtacaaaaaataaagaaatagcggttgtaaccgttatgggaaggactgaaggagtgtctatggaactaaaggttcctttctatcagaggactgctgaaaacagccacatcacccacctacattccattttgttttctctattgacatcatattcctactatgctactatgaagatacatacagaatgtatgaatattaagagaggaggtactactaaaaatggctggcaataaatatcctgaaataacagaaaaaactatattggatacagctaaaaaattgtttcttgaaaagggctatgagcatgtgacattacaagatattgcagatgcctgtggtttgacaaggggggcaatctatcatcatttcaagggaaaagtagaaatgatagatgccgttactgattacatgtttaacgcagctactttctatcaagatattaaagtagacgcatcgctgaatggcttagaaaaactacgacgcttattcgttgcttctatgaccgacgatgaacatataaagatgtacgccatgctctcacaaacattttataagagccctaagttagtatcagcatatttacttgactgtcaaaattcagttatccctataacacaggaatatattgaggaaggcatagccgatggttccattaagggcgacagttctgaatatctggcagaaattgtgatggtttttacaaatctctggttaagcccgctggtgttcaaaacgacgaaagagaagctgttgcttagagtaaagtacactaagatcatgttggagagcatcggacttcctcttataaatgacgaagttattttggctatcgaaaaaatgtgcaaagtcctctatcaagaatagattggttaaaaaaataaattgtctgaaaggcaatttatttttacccaaaatcatacattctgtatgtatgatagcttgaaaggggctgcaagaaagaggcgtgttatggctcaaacgaaatccagaagctaccgtagaaaaaatacttgatgtattccaacgactgtttatgaaaagggggtttgacaatacaaccattcaagacatcgtaaatgagatggacggcttaacaaaaggagcgatttatcatcactttaagtccaaggaagaaatcatggaagttacttgatgatgaaatcaggaatatggtagatcactactttaagcaactcacagcaacagagtagcgttaaatttccatcattcaatcggtgttaaataggcgataagcctttttatattagtcactttcataccaacaaaatatatcaaaggaggccattatcatgacagaagaaagatttgagcaagttattgaaaacgcaatcgagggtgccgctgacaagtttgaccactccatcaatcgcgcatggaaacatcggccagtccgcattatcggaaaaagtattgcctgcttatcgggggtgggcttgcttgccgcatcactgcctttatttgaaaaggggcagaacaccgccgcgaaggtctgcttaattagcggaggaattgtgatagcgtgcaacgctattgaacttttcatttttagaaggaaataaatatatggaaaaccgcattgaaaaggataattttccatttgtaatagcaggctcagctgtccttttatttggaaagtcaatccttaaagtcggttttatcctgctgtataaaaccgtcaaatttctaattaaaggcatcttcatctattaacccatatcggcctgtcattgaacatacagcagcaaaacaatggcaggccgatgcttataaatgaaacgcataggagaatttcatgtacgagaagctttttaacaaaaattttacaatggttgtcattggccagattatttccttattcggaaatgtaatcttgcggtttgccctctcactgtatatcttggatgccacagggtcggcaacaatattcggttccatcatggctgtgtccatgctccctaccataattttgtcgccgtttggcggaatgttggcggatcgagtcaatcgtcgaaatatcatggtcgcgttggattttaccacagcagcaatcgtctttgtatttggtcttgtcctgaatgaaaattcggctgtacccgctatcgcggttgtgctgattttgctttcacttatacaggcgttttaccagccatcggtacaatccagcgttccactgctccaaaaagagaaccatttaattcaggcaaattctgttgtaaatcaggttatggctttttcaaatttgcttggcccggtattgggcggtattctgtatggtatgtttggtgtagggcctatcattgttatcagcggtatcagctttttcctatctgctgttttggaaatttttatacatattccttttacgccgccaacggaaaaaggaaatatctttcatattgtcaaaagtgattttaaggacagcatgaggttcatgatatggaaacgttcagacattctcaaggcacttctatttactggtgctatctcttttttcgttgccgctgttgccattgtcggaaagccgtaccttatccgtatcacgttagggctaagtgcagagcattatggaattactgaagggtgcttaggtgccgcaggaatattgggcggtattgcggctggagtgattggtaccaaactaaagacaaaaaaactgtactatctcatggttttgatggggattttcttagtacctgtaggcttggcctttatgtttaatgcacctacttttgcttcttacttacttattacaatcgttttttcagcgaaccagttactttactgtatgttctccgtgcttatactgtctgtcatacagcagaaaacgccgaaccatcttttgggaaaaataatggcctatgtaagtaccgttgttatgtgcagtcaaccgcttggtcaagccctatatggcgtgttatttgacagtttcacaagcaatgtttatgtgctgctaattgcaacagcagttctgatcgctgcaatagggctgttggccaaaaaacccttttatagcttggatagtaaataaatcaaataacatcataacaaattgccggacgacggtaaaagaaaaaagtcgtagttctttaatctctaatggagagcgacgataataacagtctgcgaacagcggtatatgggagtataccactgtacttatatgcattgttttcaataacctaatcgttaaaaaaggctttccccattatcggataggtgcggccacaaggatgaactatattataataaataaacttcattttggttctctctgcgcctggctggtttgctataagctgggcgcttttggggttttctgtcgtctggggcacatgaagcgctgatggcccaaaaaggacaggatgcagagatgtttgagacgcagagggagtggtatcaatgagtgcgggaaagaaaaagtacaatcgaaatcagccggaaggtatccgggcaatcaccatgttctgtatgattgtatttgtctgcatgagtttttatgaggtttatttttttgtcaatcggagtatatctattccggctgaaacctatgctgatcgttacgctgattcttgcattcatcccggccatggcggcgcaggtcattaatgtaagagtgttcaccattgcttcagcttttattttattgtatgatgtacccatagatgtggacacataaagaagaagggttccctaaaaatggacactatgtcccatccgggcaaattttaatgtcagtgaagaggaactggaaatatttgatcggaagtttcctgagaagtcgaaacgagaagcgagagaaacggatttgacataaccggatgactccggtgttatagccttccttttgacgtaaaatcaatatattaaacaggagaaaacagagaaaatgaatcagaagaatacagtcgtattaatcgtagatgtacagaatgccctcatggaagcacatcctttccgtgaagaagaactgacagataatctgaaagtcattatccataacgccagacagagaggcatggaagtggtatatgtgcgccatgacggcggtgaaggggacgaactcgccttagggacacagggctggcagatattcgatgctgcagtcccgcaggaaggagagcgtatctttgaaaaacgctataacagcgcctttaaagataccgggctgggggaatatttaaaggagaagaagataacggaaattattctgggaggcctgcagacagaatattgtatcgatgccacatgtaagtccgcttttgaacggggctttcacgtatggattcctgcccataccacttcgacctttgataatgattattttacggcagagcagcttacggagtattttgagaaaaaaatgtgggatgggagatatgcggatgtaaggccggtggaagaaataattgaaaaaatgaaaaacttcccaatttcttaataattccttcagggaattaagaacttatttaatctttgatcacagaatgaacacaattgaaaggtatgatattaacagatagttgatatacaactcacttaactatctcccccctcataaacagccttccgccattaaaaatggtggaaggctgctttattttaccaaaaaaggcactgcggctttgctgtcctgaacagttctccgcaggtttttgcctaataattatctttatctgtaaatttggcataatatttgggatcagcaaaagcgaaggtatccccttcctgcttcagaacccatttcttgaggggtgtctcttgaagcggcacacagacgatgccgagaattgccatggcgatgattcctccgagaacatccgtagctgttacattggaaatctgactgcaaagatagacgccggtaggaagaaaaagaacataagccgtaaagaatcccgggcagtaaatgaatttcttaccggccttgcggtaacgtttcagagaataacagccaaccacagtatgcgccagaacttcgccgaagctgagaatgatgatacagatggccaccatattggacattccgccaatctgggcgggaacagcataaatcagcgggatgaccgcgagacctatgtttgtgatcatatcggtaaaacggctcatgggatagcggtcgagatacctgcttccgaagtcctttggcccaaagataatattatagatataatgcaggcctcccgggcatttccattcttccaatacatggagcggcatgatgaccgccaggaaagcgccgccctttgcgccgggtgtccagctgttccagttgagtatgagtaaaaaagcaacgattacgccgagaatgccaaggcagaccagccatatgatgtcgcaccatttatccagttttttaaccattatttaatccccactttctgtagaatggaaggcttgctgtcatgatagatttccaaaaccttgtcttttttatagccatacatttcttcctctgcaaaaggataattgttctttctgtttttcataaggaataccggcgcaatgaagcagataatcatggcggcaaacgcaccgggaattccgatccagagctgtccggccttttccggcagacgggtcaccacataccatatgtaataaatggcaacaggggcctgcagaaataaagtagagccgaggcccggattataaatgtctttcagtgaaaaattgatcagcagcgcatgggcgccgagctgcaccaggacacagagcacctgggaagcgccaagccagatgacgtctggaaagcaaatcgccaggatatagaaggtgtagcataaaaatacattgcagataaaacactgctgcgcatgaaagggatatttataaggcgcttctttttcccgaaaagcagccatgttggtaatagagggcattccgccggggaaggcatattcctctgtctgatgaaccagcattgccatccagctaaatatcaggattgtctgtatgcggggcagattactgcagccccaaagccccatgaaaaatgcgagaaacacaaaaagaattcctccaatcagataccagtatcttctccagaatttcatgacattcccctcactttttatgaatgaattggctgtaatatttcggatccgcgaaagcaaacatacctttttcctgcctgataacccattttttcagcggagtttcggacagagggatgcagatgagcatcataacgactaacagaatcacgcaccacagccagtcccttccggtgatattgttcaggcggacagccagataaatgccgcagggcaggaacatcatgtaagaagtggcaaatccgggattgtaaatcgtctttttgccgtcctttttataccaatgcagagtcataaatccggcgcaggtatgcgcaagaacctcgatgaagcagaacagcatcatacaaagtgtgactgcattggaaagagaggttacgcaggaaagaagcagataaacaaggggaatccactgtaagccgacgttggtaaccatatccgtcagcctgctcataggatagcggctcaaatcctgtctgttcttttcttttgggccaagcagcgtgttataaaaatgatgcaggccgccgggaaatttccattcctccagcacatgaaagggcatgataacagcggcaaacactgcaccctgagcgccgagcggcatgttatcccagaagagggctgcacagacagccgtgatgactccggttacgcagataaagataatccagtcgatgtcgcaccatttgtctaatttccttaccatattattttgcctcctttgcagcctttgccgcttttctttcttcccagagcttcatgacgtgctctttgttatagccgtagagctcccggtcgtcaaagggatacttggaattcttgtctttcataaagaggattggaacaataaatgtcagaagcagcatggcaagagaaccgggaatcccccaccatagctggccggctttttccggcatataacggaccacataccagatgtaataaatggcgacgggagtctgcaggaaagcagtggatgcaagacccggattatatttacttttaagccgcacattcatggcgattccatgtcctggcagctgccagactccggcaagcacctgggatgcgcccatccagatcagattgggaaacaggatgggaatgatatagcttaaatagcagaaaatcacattgcttaagaagctctgccgtgcattgagaggataccgctcaggatgatccacttccccaagcccggccatgttagatatgattggaaaaccgccggggaacgcatactcctcaaactgatgcataagcattcccatccagctgaataccagaatgatctgaattgtgcccagacggtaacagccccagagccccatgatgaatgccagcaggacaaaaaggattcctcctatgtaataccagttctttctccagaaagtcatgttgaatacctcctaccaaatataaaaatttgacaaattgctttaactccattatgctaaacacatagggcttaagtcaacagactgttgatttgggattgtgctaagaccaacaatcaggaacctgatttttgtaaaagcaacatttcgttatattttgttgaggtattgatatggaaaatcaaagaatccgcctgagcaaggccatgctgaaagcagggctgctgacacttttgaaagaaaagcctctgaatcagatttctatttatgaactctgtgcagcctctcagattaaccgcactacattttataaatactatggcagtcaaaccgacctgctgaaggaaatagaagcagactttttcgcgcagctggatgaggatttgaaacccattatcgaacagaaccctgacgcgcttatttccgttttgaaccatcttcatgaacagcgggagcttttctgtactcttgtcaaagtcattcccacacaggactttgcggagcatctgtttacgattccaagcatcgccaggattttccgtaatatggcggatgccggcaattattcggaaagtgaagcaaagtacatccgcaggtttgtttttcagggaaccttcgccgtcctctgtgattggctgggaagtgaaaacccggaaccggtgtcggaaatcgccggggtgttaagcttgctgaaaagcagactctaaacttttttatctgcacccgtgcaggacatctcggttgaaaaaagcatccttctgtgctattcttatgtaagtattacgcttaaataatcattttttattaagaaaagaggaaatgatatggcagcattaaagacattacttgagaatctggatgttacggtagtgcggggaacaacggagctggatgtacccgatgttgtatacgattccagaaaaattacaaagggatgtttgttcatctgtatagaaggcgccaattttgacggccacagcgcagcggcgcaggcagtggaaaaaggagccgcggttctggtaacacaaaaggaagtggatatacccgcagatgcgcaggtgactgtactgaaggtggaaaatacccggtatgccatggcttttatttccgctgcatggttcgggcatcctgcccgccggctgaagactatcggaataacaggaaccaagggaaagaccacctctgcctatctggtgaaatccattttagagaataccggatttaaggttggcctggtgggcactatagaagttatcatcggagatactcatattcattcagacaataccacgccggaatcctatgtccttcagtcttatatggccaggatggcggaagccggatgtgatgcggtggtaatggaggtttcctcccaggcgcttatgcagcatcggagccagggcttcgtatttgattacggaatttttaccaatatagagccggatcatatagggcccaatgaacacagcagcttcgaggaatatatgcactgcaagggcatgcttttcaggcagtgccgtgtcgggatcgccaactgcgatgatgtacactgggaaaaggtgatggaagggcacacctgcgagctggaaacctatggtttatcccctcaggccgatttgcgtgcggaaaacctgcgcctgaccaaccataacggccatctgggagtggcattccgggtgggcgggctcatggagttcgacggtgaaatcgctatgccgggccggttcagtgtctataatgcgctgacggcgattgccatctgccgtcacttcggcgttacggaggatgcgataaagaaagcgctgaaggaagctaaggtaaagggcagaatagaaatggtaaaagtgtcggatgaatttacgcttctcatcgattacgcgcataatgccatggctttggaaagccttctgactaccctgaaggagtacgatcacggccggctggtgtgtgtattcggctgcggaggcaaccgttcccggcttcgccgctatgaaatgggtgaggtgagcggccggctggcggatttgactgttattacatccgataacccgcgctttgaagagccccaggccattattgatgatatcaaaacaggaatcagtaaaacggatggggaatatatcgagatttgtgaccggaaggaagccattgcttatgctattgacaacggcaggccgggagacatcatcgtgcttgctggcaaggggcatgaagactatcaggaaatcaaaggcgtcaagcatcctatggacgaaagggagcttattgcagaggtcctgagggaactcggcagatgacggaacgcttcctgttttcgaggaaaatataaaagaacataagaaaaagaagatgaggtatacatgcagggcagatttgcaaatattatagtggatatttcccacgaaaaggtggaccgcccgtttcagtaccgggtcccggaggccctttcgggcatcccggagcccggtatgcgggtgaggattccctttggcagcggcaacaacctgcggaccggctatattatagaaatgacggatgaaccggaattcgatgtgacccgtctgaaggaaatccattccatcatagaggagggcgtgcaggtggaaggccgtctgatacggctggccttctggatgaaggagcactatggctccactatgataaatgcgctgaagaccgttctgcccgtaaagcagaagctgaagcagcaggagaaaaaagaaatctgccttcgggtaagcagagaggaagccagggcggagatgctggaatgcgaacgaaagcatcagcgggccaaggccagggttctgcaggagctgatagaggaggaacgccttcctcagatgttggtggccaggaaactgaatatttccccggccacttttcgaagtctgagggatgccgggctgatttccatcaacagcgtcccttattaccggaatccggtaaagctggatgcggacagggaagaggggcatcggctcagcaggaaccagcaggatattgtggataccgtgactgcggattatgacaatgggatccggcagacctatcttctgaggggaattacgggcagcgggaaaacggaagtatatatggaactgattgcccggatcattgagcggggaaggcaggccatcatgctgatcccggaaatcgcgttgacttaccagacggtgctgcgtttttataaacgcttcggagatcgggtgtccatattgaattccaccctttctcccggggaaaaatatgatcagtgtgaaagagcgaggaaaggggagatcgatgttatcataggcccccgctcggcgctgttcacaccttttccggatataggaatcatcattatagatgaagagcatgaaaacagctataaaagtgaaaccatgccgaaataccatgcgagggaaacggcggaggagctggcaaggctccatggggccagcgtctttttaggctccgcaaccccttccctggacagctattaccgggccaggcagggacgctacaggctgtttaccctgaatgaacgccttactgggggtgagcttcctgtggtttatgtggaggatctgagaaaggagctcaaggaaggtaaccgttccattttttctgctaggcttggcgctcttctgcaggacaggctggaaagaggagagcagagcatgctttttctcaacagaagaggctatgcgggcttcgtttcctgccggatgtgcgggcatgttatgaaatgtccccactgcgacgtatcgttatccgaacacaaaaacggcacgctggtgtgccattactgcggtttcacacagccggccgtgaagctgtgcccggaatgcggatccaaatatatcctgggcttcagggcaggtacggaacagattgaggagcagctccataagctgtatccggataaaaaagtgctgcgtatggacgcggataccacgaagacaaaagacagctatgaaaagattttatccgcattttccgcgggagaagcggatattctggtgggcacccagatgatagtcaagggacatgattttcccaatgtgacgctgatgggaatcatggctgcggatatgtccctgtcggtgaacgattaccgggcgggagaacgtaccttccagctgcttacacaggccgcgggaagggccggaagaggaaagaggcccggagaggtggtcatccagacctaccagcccgagcattacagcatcctccatgcggcggcccaggattatgagggcttttatgaagaggaaatcctttaccgccagctgctttcctacccgccggtatcccatatcctggcggtgcaggtaacctccttaacggagaagggcggcgaagagctggccggaattcttaaggccctggcggaaaaaacagaagaaggcagagaggaacacacgatcctcatcggccctgctcctgcctttatcggcagaataaatgatattttccggtatgtcctctatattaaaaatccggattatgatatacttatccggctgaaaaaccggatggaacgtttcctgaaggaacaggaacgtaaagatgaaaatgtacagtttgattttgatcccatgtcctctttttagtacggtattgtttcgaaactcagactaagcaaggattctccaatcctctaaggtggtgagaagaattgccgcaaacaaatcaaacggcagtggtgggcggagagaaatgggtatcctccactgccatgaggtcaaatacgtgcgaatgtaatattcggtcgcacttcgacaatataccgagcgtggattgaaacaaaagaagaaaggtggaagaagaaaatggcaatcagaaatatcagaattatgggggatcctattctggaaaaggtatgtaaggaagtaaaggaagtgactccccgtataaaggaactgattgaagatatgttggaaaccatgtatgatgccaacggcgtaggtcttgcggctccccaggtaggagtcctgaaaagaattgtggtgattgatgtgacgggggaggacccaatagtcctgattaatccccgtatcctggaaaccagcggagagcagacagggggcgaaggctgcctgagcctgcccggaaaaagcggaacggtaacccgtccccattatgtgaaagtaaaggcttatgacagagagatgaagccttttgaaatagaaggaacggagctgttggccagagccttctgccatgagatcgatcacctggacggccatatgtatgtggagaaggtggaaggtgagctgacggacgtggaagaagtggaagaataagaaaggcagatgtatgaaaatagtatttatgggaactcccgaatacgcggtgggagcattggaagcgctctggaaagcggggcatgacataagagcggtggtaacacagccggataagcccaagggaagaggaaaagaagtgcagatgagcccggtaaagcagtttgccgtttcgcatgatatttctgttttccagcccgtgaggattaagaaaccggaagccgtggaacagctgaaaacctatgaagcggatgtttttgttgtggcggcctttgggcagatcctttctcaggaaatcctggatatgccaaggtttggctgtatcaatatccatgcctcccttctgccgaaataccggggagcagcgccgattcaatgggcgattatcaacggggaagaaaagactggcgttactatcatgcagatggatgcaggtgtggataccggagatatgctttttaaatcagaagtagctattgcgccggaggatacctatgccagccttcaggataagcttgccagagcaggagccgatttgattgtcccggcgcttgccgctgttgaaaaaggggaagtgaagccggagcatcagaatgcttcagatagcagctacgtgggaatgattgacaaatccatgggacagattgattttgcccgtcctgcggcggaaaccgcgcgattgataagaggattaaatccgtggcccagtgcgtatacttcttataaagggaaaaagctgaaaatctgggaggtttctccctgtgaggaacaaacggagggagcacccggaacggtgaaaaagctggataaggaagcaatttacatcaataccggggaaggtgtactgaaggtgacgcagctgcagctggaaggcaagaagcgtatgcaggtgaaagattttctgctgggctgcagaatggaaaaaggagaaatgctaggatgttaggatacggttattattttgaccccacttattttcttgtaattatcggagctgtgctttctatctgggccagttccagggtgaacagcacctataataaatattcccgtgtacgcagcatgaccgggatgacaggcgcggaagcagccaggatgatattaaactataatggactaagcgatgttcgggtggagcatgtgtcgggcagccttaccgaccattatgatcccaggaccaaggtgctgcgcctgtcggattccacctatggctcgggaagtgtggcagctatcggcgttgcagctcatgaatgcggccatgcggtacaggataaggacggttatgtgcccttgaaaataagaggcgcgctggtgcctgtggccaatctgggttcggcgctggggctccccatagtgatattaggcctgattttcggcctgagctatacctttatacaaatcggaatctgggtattcgccgctgccgtattgtttcagattgtgacgctgcccgtggaattcaatgcctccgggcgcgccctgcagatgcttcagagctacaggatactcacagaggaagagaccggctattgcagaaaggtattaagcgcggcggctctcacctatgttgcggccgcagcatcctctattctgcagcttcttcgtctgtacctgctggccggcgggagaagaaaccgcgactaaagcctgtttggaaatccggcggaagctgaaaggattggagtacgtatgaagacggaaagcggaataaacaccagagcccttgtactggatattttattggaaatggaaaaagggcaggagtatggcagccttcttcttaagaatgtattggataaatatgattacctggaaagccgtgataaggcctttatcaaacggctgaccgaaggcgtgacggagcggaggattcagctggattatgtcctgggccgtttttccaaaacgccgcccgccaaatgcaagccgctcatccgcaatctgctgagaatgggcgcatatcaaatcctttttatggacaatgtccccgattctgcggcttgcaatgaagcggtgaagctggcggaaaagagacattttcagcagctgaagggctttgtgaacggtgtgctgcgcagcctgtcccgggaaaaagaaaagctggtgtggcccgataaggaaaaagaaccggttctctggctgtcggtcatgtactccatgccggaatggattgtgaagatgtggctcgcggattacggcccggagacaacggaaaaaattctggccgggctgcttgaaccgcgtcctgtaaccataaggctggcggagcggcttacggaagaggaaaggcaggagctgcttgccaggctggaagaatgcggagccagtccggcggcccatccctaccttacctatgcgtatatgctccaaaaatccgatggggtcgcttcccttcccggcttttcccggggaatgttcgccgttcaggatgtgagcagtatgctggtgacggaatgtgcgcttgacgcagcacagaaaacagatttcctgctggatatctgtgcggcccccggaggcaaggcggtccatgccgccgagcgtctggcaggaagaggcagggtggaggccagggatatttcggaaagcaaaaccggcctgattctggaaaatgcccggcggatgggactttccaatctggaaatcaaggtatgggacgccacggtgccggatgagaaaatgaaaggcgctgccgatgtggtgcttgcggatcttccctgctccgggctgggggttatcggcagaaaggccgacattaaataccgggtgactccggagagccttcaggaagtggcggcactgcagcggcgcatactgaccaatgccgcagagtatgtaaaacccggcggaacgctggtttacagtacatgtacgatcaacaaagaagaaaatgaaagacaggcggcctggtttgccgataactttcctttttccctgcgaagccttgacggcggactgcctgaggcattgaaggaaaaggagagcaaagcggggatgtgccagcttctgccgggaattcataaaacggacggtttttttatagccgcctttgtacgagagggataacatggggactgatatcaaatccatgacgctggaagaactgaaaacggaaatggagcggatgggggaaaagagcttccgcgccgcacagctgtatgactggatgcactgcaagctggcctccggttatgacgatatgaccaatatccctctttccctgcgtaaaaagctggagtcggaatacccttacgtgagcctaactcctgtggagatccaggaatccaggctggacgggactaaaaagtttttgtttgccctctccgacggcaatgtggtggaaagcgtatggatgaagtataagcatggcaattccgtgtgtatttcttcccaggtgggctgtaagatggggtgccggttctgcgcctccaccctggacggctgggagcggaatctcttgccttcggaaatgctggatcagatatatgcgattaccaggctgaccggagagagggtttccaatgtggtggttatgggaaccggggagccgatggataattttgaaaatctgctcacctttatccatatactcacggaagagcatggcctccatatcagccagcgcaatataacggtttccacctgcggcattgttcccaaaatgcgggagctggcagataaagggctgaccattacactggcgctttccctgcacgccacgacggatgaaaagcgcaggcagctgatgcctgtggcgaatacctaccatatggatgaattgatggaagcctgcgcatactattttgaaaaaacaggaagaaggattacctttgaatacagcctggtggccggtgtgaacgatacgccggaggatgccgtacagctgtctgccctggcaggcccgctgaactgccatgtgaaccttatccctgtaaatcccataaaagagcggaattacaggcagtccgggcaggaggaaatcctggcttttaaaaataaacttgaaaaaaacagaataaatgttactattagaagggaaatgggcagagatattgacggcgcctgcgggcagctgcggcggcgtcatctttccggctgattcttaaaccgccggaaaaactgagtatatataatagaacgaggacgaaactcgtgaacaacagatgagaagtttggataattaatttttttctggtcagttttcttatgaactttgcagtacaaaaagcggatgcttaacaggcatctgttttttttatgcccaattttcctgctgtgatacgttggtgttttccatttcgcaaaatcatgcattatgcgaaaataaaagtaggttttaaactgacatttattagtaattattaactcggctatgcaccctattgtaaggcaagtattgtattttgtcaattaatgtgtaaaaaaaaatagtaaaatgtcgtttctggataaagaagtaatatattgctgaaaaaagatattgtcacaaatattcttgacaattgaaagaggttatttttcgcaacacctaaagggcatttacacttcgtaggcagtgcagttaatttatgggccgtcaaatatttcgtcaggataatggaggagattatggcaagaaaaggagaaaatatatataaaagaaaggatggccgctgggagggtcgttatcgtatgaataacccggctgacggacggaaacgatattgttctgtttatggaaaaacctataaggaagtgaaggaaaaacttttcataaggaagagagaacacattctggacaaaggtggatgcggttgtctgcctgatggcataacaatgggggaagcggtaaggatgtggcttgaggaacgcaggtatcgctggaaagaatccaccttttctacttaccgttccattattgaaaagcatattctccctgtaataggaaaatggatggtggaaacatggaacaccacatcatatcgggaatactttaaaattctgcgtaagagaaaggaaggaaaagagctttctgagaactatcttcatcaaatccagataattctaagccaaatcctgcggtttctggatggaaaatatcattgcggcggactggaacagccccatacttatgccgcagtgaaacaaagacctgttcatactcccttgggaacggatatccggaaattagaagagtacctgcagaacgaagctgcaaagggggatgtgacctgcctgggaattctgttaaccggctgcagcgggatacggattggggaattgtgcgccctgaaatgggaggatattcattttgatacaggaactatgcatatagggaagactttgcagagaatccgcacgtttcaggataatggtgaagaaacaggcggttctcatgcaaccggtacgaaaataacgattacttcgccaaaatccagccattcagacagggaaatccccataccggatttcctgttggaacttttacaaagaaaaaggaaccagaaaggttatcttatatcgggaaagaaaaaagagtataccgaaccaaggaccctgcagtaccgttttcagcgaatcctgaagacacttggaattccttatttcaatttccatatgcttcggcatatttttgcaacaaactgtatttcccatggatttgacatgaaaactttgagtgaactgttaggacattcaaatgtggccaccactatgcgcatctatgtccattcggatatggaacggaaaaaaatgctgatggccgattatcggatgacggcttaacccgggaaggatatatcttcgtaccttttcatttctaagccgtcaaaaaaatggtcatgattactacaaatatatagtgaacatctgctttttttatgtcttttcgcttaatgcatgattttgcgaaaacacgaaaaaattggttttaaaccggtatgattctttatttattatatacaatctgttacttcggtatgtaagccaaacaaaagatgacataaacatccaagtataacttacattgtataacagatcggggaacttcggaaggtggaaagaatgcagaaggacacatacgatagaaaagctgtcggaaatcggataagagaaaaccgcaggcaattggggattaccatgaaggaggcagcggaaaaactgggaaaagtaccaacctattatgccgatattgaacggggcaactgcgggatgtcggtagaaaccatgctcgccatatcccatctgtatcatatgtctctggattacctgatatttggaaaagaagatacgaaagacgaaaaggaaatggaagccagtaggatatattcggaggaaacagaatccgtgtatcagctgttgacccatgtatcaaaaaaagaacggatatatgctgccaaggtcctgcgtacttttctgattgcctgcaatgacatcgggacagaagaaagggaaccggaggaaacaatatcagccgagacaatagggaggaaggattatgagcggatggattgacatccactcccatgtgctcccactggtggatgatggggcggaaagcgttgagatggcgctgctcatgttaaggacggcggcggaagagggaattgaaaaaatcatactcacccctcatcaaaaagcagaccgaaggtgtgtcacaccggagggaattctgcatcgaatgaaagaactgcaggaattagccgtgaaagaacacattccggtgcggttatatccgggaaatgaaatcttctaccgccatggcctgccagaactgctggaacaggggaaaatacgaaccctggcggattcccggtatgcccttatagagtttttgcctggagaagattattcctatatacgggatgcgttagggagagtggcttccttcggatattggcccatactggcccatgtggaacgctatgccaatgtgataaaccggatggataaggcagtggggctgaaggaagataccggctgctatttccaggtgaacgccgcaagtataacgggggaatatgggtttactgccaaaaaagtgacccggaagctcctgcgggaggaactggttgaatttatagcaacagacgcccacaggaacgaagggaaacggagccctaaaatgaagacctgcgcggaatgggtggaaaagaagatgggacgggagcaggcggaaaagatattccgcagaaacccggaggccatactggcggaccagatgatttgaagcggtcctgcagagattcttttgccgggaaaaccagaacagttagatgccttgaataacgatagaaaatctatataagagaaaataaagacagacaggaaaatggaatggagaatacaaaagggatggaaaaagatactgtgcaacagacagatgagatagaaattgatttatgggaaatctgccttgtactgatacataacctggcattgattatttcggtaggcatcatggcggcgctagtcgcttttctggcaacccagctctttggcgtgcccaaatatgaatccaccaccaagatttatatcctgaacaagcaggaaaacaatgcggtgacctattcggatatccagctgggaacccagctgacaaaggactatgcggagctgatccagagccggtttgtactggaagaggtggttcaggggatggggctggatctcagctatgaagagatgaagaaaaaagtttcggtgacaacgcccacagacacccgtatcctggcgatcacagttaccgatacagacccggtgatggcgatgcagctcgccaatgccatccgggaagccgcggcggtgcatatcatgaacgtgatggatatccaggcggtgaatgtgtcggaaactgcaaatatgcctatggagaaggcagggccgagtgtattgaagaacacgttcattggcggtgtgatcggcgtgttcctgatgatcgcaattgtgctggtgcgtttcctgatggacgataccgtgaagactccggaggatgtggagaaatacctgcggctttccaccctggcggtgatccctttgaatgaaggggaaacggatgcgaagaagaaaaagaaaaaagtgaagagaaactagtatggagaggcagaaaagagtaccggatggtcggttgcttttctgctgttatcatgtgcagaaagaaagcgcacagctgtgaaacactggaagagaagacggccgcgacggcccaatgagaacggctataaagggataaaggagaacgggagaatatgcagacaataacatttagcgccatagagaaactggattttcggacaaaagaaagctataaaaccctgcggaccaacctggaattttctggaaaagacaggagggtgatatccataaccagcagtacgcccaatgaaggaaagacaagcgtttccttccagttggccatgtccatagcggaaggtgggaaaaaggtgattctggtggatgcggatctccggaaatcggtgctgaaggggcgctataaaagtaacgccgcccggtacgggttgtcccactacctgagtgggcaggcatccatttccgacatattctgcaaaactaacatccccaacttttatgtcattttctccggcccggtgccgccgaaccccagtgaattgcttggaaatgatgccttcgggcttttgctggaatatctgcggaaggaatatgattatgtgattgtggatacaccgccccttggcagcgtcattgacggcgcggtggccgcccggtattgcgacgggacgctcatcgtgatagagagcggagccatcagctacaaatttgcccaaaaggtgacggaacagttggagaaggtggactgccggatcctgggagtgatcctgaacaaggtgaatatgagcgggaagggctattatggagcttattatgggaagtattacgggaaatattacgggaagtattatgggaacaatgaagaaggcgggctgcatgcggccgtggttcagaaggggctgaagagcggaaaagcagcgaaaggggaagaaaacacccactcacatgagattaaaaacggttcggatccggtgaaagagaaaatcccggaagagagccagatcccggaggatgacatgatccaattggatatagatatggtggaactgacggaagacacggaaccgatagaagaactgaggtaaagggagatgggaagatggatataaaaaagatagtattcataatcggaggaatagatatcgtgctcctggggataagcctgttcctgtatctgggaaaagacaggacggcgccagtgattacgttcgcggagaacctggtgagttatgaggaagggatggacgaagccctgctgttggaaggggtaacggctatggatgcaaaggacggcgatgtgagcggcagcctgttggtagaaaagatagcggggacgacggggaaagaagtgattgtgacgtatgtggcgcgggacagcgcgaataatgtagggaaggcctctcgggcattcccggtggcaggaacatataatgatggggatgtgctcccggttatggggggagtcatggaaggagaaagcgggactgaggaaggcagcgtgacggaatcggagacagagacgaaaacggagacaatgagcggggaagaaagtagcagcgcggaggatgatgagggtagggacgaagcggatgcggaatcggatagaagggaagaggcacgccaggaggaaccggcagaggaacccgaaccgtcggcggggccgaacccggtgctggtgatgagcggggatgtggtgagcacgaaggtggggacacctccaaactggagccaggtgatagcggcgatgtcggatgataaggatgattacaatacactttataagaatttgaaactggatgggcatgtgaagctggatgaagtgggggagtattcggttacgctgtatacggtggatacggatgggaaccggtcggaggttagggatttggttgttagggtggaagagtgagaagatagggcagaccgcaattaaaataagtgatggttgaggatgtggttccagaaagggtagggatgaataatggtggggtattttcgatttaaggtggtacatagaaaagtttctgactgaaaagaactcgacatgatagctgtactaaatgcgaaggctgcttatggagatgtacaattaatattgttcacaataacgccactccagaacacataaattttggattgttgaggtcatggcggagagatttctatggtagacgaaacgtagggtagacataggattatagagttgtcattggtatttgttgaattaatacaaaagaagattgaatagaggatcgcaaaaaaaggctgaaacttttcttgtagggtaggggtggcagaagatgtgtactgatattggcgattaagaaaattaaaattttttttgatgtgtaagggagcttgaagctttgtacagcattgaaaatccggtgatgaaccgatggagatagggaaaatgaaaacttaatttgtagggtagaggtgcttcgagataatgagaattaaaaacttattttgttgggtaggcacgaactaataagcctaagatgcgaaagagggacacaggaagctgcctctcacagcctgatttcattagatagataactcaatacagtttcaaagctatatacagtaacattttatacagtaattaagatgaagagcagtggtagtccccacagtcgatatgagtgctgtggttatacatgagcattgctgtgatgagcttaccagctcggaagagccacacaatgtctccgaataccacaaaagaacataagggggagagcagtttagtggacagtaaaaagagaatcctgtttgtcgtggaagctatgggcggcggtgtgttcacctacatagtcgatttggcaaacgggctggttgacaaatacgatatgtatattgcctatgccgtccggccacaaaccccatcaggttataaggattatttcgataagaaaatccatctgattgaggtgaagaatttcacccggtcggtggagtcctcaaaggacataaaggcatttttggaaatcaagaggattgcagataaagtcaagccggatatcatccacctgcattcttcaaaagccggtgctttagggagatgggctttcaatggaaagaaaacacctcttttctatacgccacatggttatagtttcctgatgaagaaccacagtgcagtgaagagatttacatataagatgattgagactgtgagtggtgtgcggtcttgtacgaccatcagctgcagcgaaggtgagcatcaggagaccctgaaacttaccaagcgtgctacttatgtggataacggcatcaatatggagcagttggacagcctgcttacttccatacagtcagacgagaatcatcccttcacggtgttcacgctgggacgcatctgctaccaaaagaacccgatgctgtttaatgaaatagcaaaagccttgccggggattcacttcctctggattggggatggagaattaagggaggaactgacttcgtcaaatataggaattacaggatggctggacaggaaaaatgctctgtccagatcagtgtcggcagatgtattcctgctgacttctttgtgggagggacttcccatctcgttactggaagctatgtatatgaagaaaccctgtgtggtcaacgatgtcatcggaaaccatgatgtcatccacagtggggtaaatggttatgtgtgtcaaaatgtatccgagtttgtggagagtattgagaacgcccagggcgataagagtgctgggctggtcgatgcagcatatgaggatattttgaataaatataatacagtcattatggctgagaaatattccgctatatatgatgaagccctcgtgagattcgggggggggtattactatttagtatatatccagtctgcaacattcatctcgctaactgtacacagtttacccactgcaaacattcaaataacactgtggtctacgaccgctgctgtgcatgagaaggcggtggcgtagatgaatagagaatattatagcaatgagaagctgaatggcagtgagaatctgcatggtagtaacgaccttcacattgtatatgcctctgatgatgagttcgccgagattcttggcgtatccttgacttcactatatgagaataacaaggacatggagcagattcatgtgtatgccctcgacagcaagatatcggaggagaacaagaaaaagctgagttctgtaagtagaacttacggaagaagcgacatccagtggatacctgcgaaagatattagcgaagagctgaacatggatgtggttgtggatcgtggctccttgagccaatacgccagactatttgtgtccagtgtccttccggcagatttggagcgagtcctgtatttggactgtgatattgtcatcaaccaatctctggatgaactctggaatctggacatgcacggcaaaacgatagctgctcttaaagatgcgttcagtaagtggtacagagctaatatagatttgaaacccacagatatcatgttcaactctggggtgatgctgattgacctgaaacgctggaaagagcagaagatcgagaagcggctgatgaagttcattgcttctaagaatggcaggattcagcagggagatcagggagcattaaatgctgtgctttctcatgatacatactgctttgagccgaggttcaattccgtgaccatctattatgacttctcatataaagagatgatggtgtaccggaagccgcctgagttctacacagaagcgcaggtaaaagaagctacggagaatccggtgattattcatttcaccacgagctttttgagcagacgcccttggattgaagggtgtctgcacaggtacgttggagagtggatgaagtacaaggatatgagtccttggacagatgctccgctgcggaagtacaagaaagcaactggagtaaagggaatcggtattaagctggctgggaaactgccaaggaaactgatgattacggttacaggtatagcacaggcgtatggaagacctgtgatgaataagataaagaattgaggagagaggtaagaatgcagagacaaagtgtcgcccttgttacaagtggatattttcctgtgccagcaacacttggtggggcggtagaggctctggatgaaaaccttattaatcagaatgaagtatcggggaggctcaatctggttgtgtttagtagttacgatgttaaagcgaaagaagtggcatcaaactataaaaatactgaagtaaaatttgtcattacgccagttctggtgaaagtctgtgacaaggttatatattttgttgcgaagaacatactcaagaagaaaaaaagcctgtcataccgctacatagcgcagagattatatttcataagcaaagtagcgaagacacttagagatgaagattttgataaggttgtactcgaaaatcattcaactcttttcatcacgctgaaaaagcacgacaattacaaaaagtacgcaagcaaatattattatcatcttcacaatatcgtgactaatgattatggatgtagggaaatcatgcagcattgtgctggtgtaattggagtcagtgattatatcaacagtaccttacgctcattcttaggagacggagataaatcaaattactttgttctgagaaataaaatagacagagacaaatttgcaatctcgcttagttttgatgaaaagagagcattaagagataagtatggcattagcgatgacgagaagatcgtattgttcactgggcggtttagcgaagaaaagggaatacgagaactgttggatgctttcggtaaaataaaggatgaaaatgtgaagctccttgtcgttggtggttactattttggaagcggtatgagaagcccttttgaagaagaaatgaaaagtaaggccgataaaatgaaggatagggtggtgtttactgggtttgttgagtattctcagattccaaaactctatgctattgctgatgttgttgtaatcccatccatgtgggatgatcctgcgcctcttactgtcattgaatcgctgaccgcaggcaaggcgctcattacgactgattccggtgggataccggagtatgcgacagaagagtccagtatcatattaaaacgggacgagtcattggtggataatcttgcgtcatccatcacaactgttattaacgatagcagcaaaagaaatcacatggaaaaggctgcaggagaacttacgaagaactggactatggaagctttctatgaagatctttgctatctgcttaaaaaatagaactgaaacgtgtgaaactgtaataatatctgaggagcatggaggttctgctaatggcattgtcgatagggagaaagaattgaaatgttagcatattttatagtcataccattgattataggcatgggctatttaagggatcattgcagaaaagaacagaaacaagccgctgatgtcattttgtttctggcaatgtttctgtttatgggaatcagatacggcattgggcaggattacttttacacttatgttcctgtttttaacacaattctcgaaacaggtacttatagtgggagtgaagttggattcatattcctaaataaattatgccagatttttactgataattatcagtctatatttattgttacttcgttcatactggttttattcgcatataagagtattctttataacaatactacgattttgatgtctttgtatatattcttgtgtggcggattttacttgtattcatttaatgtggtcagacagtgcattgtaatagcgacatttgcttacgcaatttggtatatagaggaaagaaaattctggaagtacgcagtgctaatttgtctggcagcaacaattcatattaccgctcttgtttactttccactttattttatcgcagatagaaagcttgttagaaggttcaaactaagaacgtatatcataatgatagttgcgtacctgcttctgagaaggtatattccggacattttgaatgtgttgtttgaagggacaaaatacgctaactatttatcaggatactgggctgatacttcaaaagcctttaatgtatctcaaattctgaatatttttgtgtttgctctatattgtttctttgttccggcagaaacgaatgaggttgaggcggatagaaaggcaataatgtataaaaacatacatttcattggcttgctgtttacgtttttaacaggtctagtaccattgatttttagaatgacgacgatgttttatttgcttcagtttctcagtgttccttacctgtatgagaactacataccaaagcggtataagaatattgcgttatacatgattattgctatttacggggcgctgttcctcaatacggtcattagtaatggaaacaatatcgttccctatcagacttttctttgtaaatgataaagctgaatttagaaatggagaattgaagtggacgagcaaattagtgttattgtgccaatatatgcagttgtagaatatttagatgaatgtgtggaatcccttcttagacaaagctataaaaatttggaaattatacttgtggacgatggttctccggataactgcggatttatgtgtgattcgtatgcggcagaatacttacaaattaaggtaatacataaagagaatggaggactatctgatgcgcgaaatgctggactaaaggcaagtacagctgaatatgtgctttttgttgattcggatgattttttagaacctacgatgattgaaacattatatgtaaacctaatcaactataatgcagatatttcagtgtgtggtattaacaaagcttattcagatgggagaagggttccaaaccaaggtaaagaagatgtcgtactcttggataaattccaagcaacaaaaaacttatacacatttgatagttatggagtgggggtatggaataaactctttaaaagggagttattgttaattgaggggtttccggttggaaagctttccgaagattattttgttatgtttaaatactttatggcggcgcaaaacgttgtatatgattcaacccccctttacaattaccgacagcgagagcagagcattactaaaaagaagagaacgaatataggaatgtacgaaggaatagaaaagtactataagttcactagggatgtgccggaattagaggattctggaacgcatgcaattgtgtttggcagcttggcgacatataacaacataatgaaaaacaaggattataccgaacttgtgcctgacttaaaaaaaacaataagtgagaattacaagcaagcaatgcgttatgaaagctgctcaaacagaaagctgcagttattcatattcaagtactttagacctttttatccattagcatataaagtttttatgagtaggaggcagtgaaatgatatctataaaagggatattgatgaagtttgttcttggttacagatcagattctgcttcgtatgttaattatttaagaatgcaaggcttcgatataggagacaatgtaacaattaactacccttggaattttgaaatagacaagcagggaccttggatgattaaaattagaaataatgtggtgttttcaaaccacattacgatattgcaacatggatacgactggtgcgttttaaaacatctatacggagatgttttgaaaagtgccggaaaagttgtcattggcagtaacgtatttgtgggtgcaagaagtgccatattgaaaggtgtaacaattggtaacaacgtgattatcgggagggggaagttctttagtgacgaaggattgcgtaaaacctagcgtatatgcaggagtgccgtgtgaaaaaatcagcagtattgatgattactacaaaaaaaggaagggcttgcaactcgacgaggccgaagatatctttgatatgtactatcaaaagtatggaaatatatctgaaattttctttttatttgaaaatgctcctattgaagaattaaacgaggagcatgtaagggttctaaaattggctgatagctatcagaagagtgtggaaagatatgagaagagggaaagccggttctctgattatagcgaatttgttgagtattgtttaaaagagtggactaattcatggtgttttatgatttttatttgtgcgggaggtgagtgttacgatgcgagtaattgtattttcgtgttttaccccataccatctaattaactcaatatattatgcgacgagcctccagcaagcaaaaaacttaaaaatggttttagtctggaataataaaagttctcggtcgattaatcttgatgttttcaaaaactgttttgacaccactattgacataagtggttttgacgaaacaaatattcgcaggaaagtggttaatcagtctgtctacatgggaagattctttggcttatcttcaatagcgaaagccattaataaatacgatagtgttcgccttgtgtgctttagcgatcaggattttgtaacccatcgattggttgagtatgtatctggcatgaacgactctgagatagttttggttgaagaaggtatgtctacctatttaaccaacacagagtatcattttagtgttttaaaaagaatctattacaaaattcttggcatcagaacagaaaaatttatcggagcaaatatgcatatcaaaaccgttattgtaaagcacccggaagacatgccggtcgtcaaaacccatgataggaagattatccgacagaataatatttttgctgacgataattgggtgaagaaatttaatggattgataggtggcattgaaaatatagtacaaatgcacaaagggaaaaaaattatcctgtggatagggcagccattgatagaacttggagttccagatgaaaaggaattacagtttcttgttgaaattaataataagtttggaactgagtattcgatagttattaaaaagcatccaagagaggctgaggataagtataaatcaatattaggagataacatttctgaggttgatttaggagatcttttctggattcccttagagtttttgggaactgtactttgtccccaaattatagtcactgccttttcaacagcggcattaaatcttttggagcttggtatagattcaaatgcatatttttgttacaaggcttttgggctgaatgtagactcggaattttttgataaacataaagaagataatatttgtgtaattaattctatggctgagatggaacagtgtcataagaagggtatctctaaaagaatctgcacaaatatgaatgcagatatcgagtatcttgaaatatttggttaaagcttcaaagaggcgtttatatattgcttaatccaatggatttatagggaggaaactattatgtacaagaaaccgtttgttatcgctgaggcgggatgcaaccacatgggacagatggaggttgccaaggatttaatagaaacagccgcacacttttgcaaggcggactcaatcaagttccagaagcgttgcccgaaggagttgttgaccccggagcagtacaatgctccccatccgaaccccgcaaactcttatggtgacacttatggtgcacatcgtgagtttttggagttcactgtggatcaacatgcacagctgaaagagtggtgcgaggaagctggcatcatttactctacatcagtctgggatatgaccagtgcaaaggaaattgcttctttaaagccagtgtttattaagattccttcagcctgcaacactcactatgagatgctacagtggctgtgtgacaattacgagggagagattcagctttccttcggtatgacaagccatgaagaagaggaacagattgttcagttgtttgagaagaatgaccgcgctaaggacctcgttcttttcaactgcacttccggttatccggttccgtttgaagatgtgtgtctgcttgaaatcaatcgtatgcgtgaggcttatgaggatcgtgttaaggctatcggattctccggccatcatcttggcatcgccgttgatgtggctgcgtacacactcggagcagatgtgattgaacgccattatacgcttgacagaacctggaagggcaccgatcatgccgcatctctggaaccggatggaatccgtaagctggttcgtaatttgaacgcagtccatgaagcccttacatataagccatctgagattcttccgattgagcaggtacagagggacaagctgaagtatcggatgcactaaactgccctttctatggtattgcattatttgaagggaaatagatagatgaataataatttaacgctctttactgcgtctcctgacatatcggttcgggatgcattgaagatgatagacgaaaataaaaaagggtttctcatcattgcagacgataatgatgctgttcttggaaccctgacggatggagacgtccgtcgggctttcctgaaaggcgcatcggttgatgacggaattgagggactttataccagaaactcaaagtttctcaagcagtctgatggtatcccaaaagcgactgaaatgtttaagagtgagtccattaagttcctgccaatcgtagatgaggaaacccggctactgaacataataacaaaaaatcagatgcatgccctgctgttgcaggatatccacgctgatttggaatatgattttatgagccttgatgaaggaattgttgattatgagattttccagagaccctggggattctacaagaccactgtaatgaatgactatttccagtttaaaatcatcagtgtcaatccaaaatcacagctcagcctacagtcacacaaccacagggaggaacattggattgtcgctcacggtgttggcactgtacagatagaccagtcaattattgatgtccactgtggtagttcggtgttcattccgaaaggtgcaaagcatcgtctgacgaacaaaggggataaggaatcacttattgtcacagaagttcagattggtgattacttcggtgaggatgacatcatcagatatgaagatatctatgggaggatgtagagagtgaacgtagcttttattccggtgaggggcggaagcaaatcaatacctctgaaaaatataaaacctatctgcggtaagccgctcgtttactggacagtgaaagcatcctgccagtgcaagtatatagatgtcgtatatatcgccacggacagtgataagatcaaagaaatcgtggaagcgtttaagtgtggtgatgaagcggaaaccttctccaaagcacaaatcatcgggagaagtgcggagtcggcatcggacacagcttccacagaatttgttatgattgagttcgcggttaattatgattttgacaacatcgtacttgtccaagcaacatctcctatgttgacagctgctgatttggatggcggatttgaattattcaatagcgatggaacggattctgtcctctctgtcgttcgccagtatagattcctgtgggacaaggatgagaatggaaatgttacctcaagtaattatgatgttttccatcgcccgcgccgccaggagtttgatgggtatctgatggagaacggagcgttttatatctcttcaaaggctgacctgattaagtatcagaaccgtgtctctggcaacatcaaagcttatgagatgtgcgaagacagtgcttttgagattgacgagccaagcgactggatcatcattgaagcgttaatgcggaagaatggactggtcaaagagaagcaaacagttgaagaggaagaaattgctgaagaaaggaaatctattcctgaaatcaagatgttcctgactgactgcgacggttgcctgaccgatggcgggatgtactactccgagaatggagatgagttaaagaaattcaataccagggatggaatggggtttgccttactccgtgccaagggaattatcacaggcattattacatcggagtctgttgaccttaacaggagacgtgcagaaaaactcaatttggatgtactggaagccggctgcaaggacaaggtggctgtggttaagagactttgtgagcagtacggtataggattagataatgttgcttatatcggtgacgacatcaacgatatggaagttattaaaatggtagggtatgggtgcgctcctgccgattcaatgcctcaggtgaaagctgttgcagattatgtgacaaaggctaaaggcggcgaaggtgttatccgggaagtggtatcccttttggaaaagtaattgcaagtattatggttgactggaattgtgaaatgaggaaatagacgcatgaaaaacaaagcaaaagcagtattaaataaagcacgacatgcaatagcggaagtaagtcatttgccaaagagggttaaaaataagattgaagattctcgctttgattatgaggtgaatagagaaattgggaaaactataacgcttgatgtttctgatgtgttttttatccagttcacaggaaaagaattgtggcggtatgatatggtagtacgttatctagcaatagaaaactactatgggcagaatgctttaggctttgatttatatcgaaaaatgcaaaatgctcgggttgaggaagggtattctgaacaggcagaaattaggtttaaacagcttatagcatcatatgagaacgagggttatgataaagaatcaaaaatagtagttgataagaacttgaaacttattgatggctctcatagaatggcattagcgatatatcacaatcaaccaacaatctcagctcttgtaattaacggcgaacgttttgtagattattctatagactggttcatgaaagttggatttacagatgaagagatggacatcatcctcgcaaaagctatcgggcttaaagcaaagatgaataaacctttgtcctgcgtaatctggaacccagctatagatgtagctgattcaatagtaaaagatttggggtattatgggaatgttctgtcatgcaagacatatcattttagaccgtatgaatataaaaatattgtgcgtgctatttatgcaattgacgatattgaaaaatggaaaatagaaaagaaattggagtatatgggggaaaacgcagatactgtggatgtggttgagctttcgtttgatgatcctcaatatcgcataaaaggagccacgggacttcctctttcgataaacggagaaaggacaaaacaggctcttagaaccagatttcagccctatataaagaattatttttttgatattatcatgcacatcgcagataatcatatgcagtcggagtatatgtggagagtctttgatccgggcattgattgcagaaaagcaattagcatcttaaataaataccaatatgttttgaccaaggttgatgtcccgtattatcctgaggattttccagatcatattccggttgggagggatatggatgttatctgctctaaagatgattttccaattatccgttctgaactgctgcaactttcaattggttatcctgattatgaaattgtcgttcgggattttccagatagactgctgctgcgttttgaactatcaggaaaattaattttcctgatagactgctgttgcgctataaaagaagtgccagatgaatttatcacgttaggattaaaactcaggaaaaaaacttctaagggatactatattttgcaacctgctttcgaagctctaatttgcaagatggcatatgaggataataataaaaaggagtatcatatggagtattacaatgtagataaggtgtttgaaacctttgaggaagcattagattcccatgcagggggtatagacagattccttcctgagtttgatgagtatctgcgtaaaacgggtatacctttggattcagtatgtatcgttggtagcgctgttcttgatttgattggaattagggagaaccacgatatcgattttattgtgtctacaaaatttgacaaggatcaaaaacattacgcgactaaagtaactgattctggaaacatagaaaaagtatctgttgattggctgaataaatctggaagtgtgattgtatcagatgacgaaatcattttaaatccgatttatcatttcaattacaaggggcataagattacaaggctgtcattggtagctttaaaaaaatcacttacgcgaagagaaaaagatttagctgatttaagtacattacttgcatactttgatagatccgaaaactatcgggggggggggtaatacaccattatagtgtaatcgaaattggcattgatataaggtctgaaggcaaaatgttaggtatgcttggcagctccagtggattggaggtggcggcatgagaaacattcctgtactatttgtaaaaaagattaaaaataaaataacataccttcggtcattatatatagggaaaaagtatattaagaaagaagaacacattgaatgccacgataaatttagccaggtgacttatccgtatgttggtaatgctggcgatacagtgctctcacagtgcgttcgtcgattctttgaagggaaagttagcaacacaggctggaatataatcgaagttccaaattccatcacacagaagacaattgatggtattaatgcaaccaaagctcttataattggtggaggcgggttgttcttgcctgacacaaaccgtaatgatataagtggttggcaatgggcagtcagcaagaaacagcttcaggatattaatgtgcctataatcgtttatacagttggatttaattacttcaaaggacagattcccagtgaattgtttattgaaaatcttcgtattctttgcaacaaagctaactttgttggactcagaaataaagggtcagttgaagcaattcgggaacttcttccagatgaattaaaagataaaataaagtatcagccatgtactacaacctttattagaaaaatttatgctgatacattgccaataaaagaagaatcgaaactggttgcctttaatatggcgtttgatcgctcagaacgaaggttcaagggacaaaaagaggaaatatgtaatgcagtagcaatggttgcgaaacgtattgaagagttggggtataaaattgttcttgtgtatcatgtgaaatcggatgagcagatagcaccatacatgaaaaggcatggggttaagtttacaattaaggatatgacatattctatcccgaatgaggtgtacaggttctataatggagtacaatgcgttataggtatgcgtggacatgctcagatgattccatttggattgaattgtggaattgtttcattaggcacgcatgataaaatgcgctggtttcttgatgatataggtgctgctgattggtatattgatttaacagtggaaacgtcaacgataagcgatagaatttttgaaacattcaagaggacacagatatctgagagagaaataacttggacacgattgctgaaggctcaggaattcctgtggagtgtaacagaggaaaattggtgggagataggaaaatatttaagctgatttaaggattggagattattttatggaggcagagcagggcagcgaaaaaaacaatacaacaggagtagcacttaaggccggaatgtggtatgtagtgtcttctgtaatggttaaggctgtatcagtcattactacgcctatattcacaagaatattaacaacggatgagtatggatatgtttcaactttcgcaacatggtattcacttttacttgtaatatgctcgttgaatctcacatacagtataggcagagcaaagattgattttccagacaaattggatgattacataggctcatctcagcttttatcattgcttgtttcagttataatcgctgttttgatgattgtctttattaagccggtatcatcactgctcacgttaagtgaaccactggtatacttgcttttggcttatctgattttttctccagcaattaattttgcccagaatggattcagatataggtataaatacaaacagaatattgcgatagcttggtatacagcagtagttacatctgcgtgttcattgatatttatactttgctttgatggtgatggtgcattttggcgatgcgctggtcttgttttgcctacaattattctatcgagtgctttctggattaattctataaggaaaaatcgtgtaagggtgaatgtagagtattggaaatatggtatgactctttcaataccgttagttattcacacattatccctacatatcttagcaagctcagatcgtatttttatcactaatatatgtggcgcatccgatactggaatttatagcttagtttatcaatatggtactttactctcaattgtaaccaatgcggtttcagagggatggcttccgtggttccatgatacttatcacgctgggaaattcgaagacataagaaaaaatgttaagtcaattgttgtgttagggtgttacgttgggttggcgtgtatagcatttgcaccagaggcaatatcaatactcgggggtgaaaaatacgctgcgggggcatcctgtgttccaccaattgtgctaggcattatatgtcagtatatttatactcattatgtgaacattgaattacacttgaaaaagacgaaatatgtttcatttggcaccatatttgcggctttattgaatattgtgctgaatgtcatgtttatacccgagtatggatttgtcgctgctgcttatactactttgtttagttatatttctcttttgcttatacattttatcataacgagaaaaatacttcacgttaaactctataatgattcgttcatttttggatcatttgttgtgactgctttggtttccgttccgttggttatgacatattcaatgcatttaattagatacattctgattgcagtgggatttgcatcttttgtctttgtttatcataattatattttttactatataagaaaggtgttacataagaaaaataatcattgatctgaacaagaaataggtggattgggaaatgaagctacaagggacgtttatattagttgcagacacatcggctttgtctggaatcaataacgtgattccatccctagaacattgcattaatatcgcagtaatgagcacttgttattcctgctgacatcgtgttgtcatcggtcatcgatgccactgcatcgcctccatcctccgctttgtgttggcaggaatatcaggcactcattgctgtgatattaatgcaatactgtactggtataagaatcaacacaatacaatttttacattgctccccgactactatacaaatataagggtataatataaaaatcaaaagaataattatttaaggataggccaaagtacatgttgcacgatactgtagcttgtccttttcctttttttatgttagaatgtgcattgaaattggcaatgaatttcttcacatacgatttgataagttttgagaaagacgcattgaaagacgcatttttttataaagtgccgtatttacaatgtctttctttctgttggaataaatgttactattagaaggaaaatgggcagagatattgacggcgcctgcgggcatctccgctgccgccatctcaccggagataaggaaagggaagtctaagtgaaagcattttctatcaccgatatcgggaagaaaagacaactgaatcaggatcatatatattcctccctggagcctgtcgggaacctgccgaacatttttctggtggcagatggcatgggaggccataaagcgggaggttatgcttccagctgcgctgtggagaccatacttgagggagtaagggaatcggaaggcgtacggcccgaggaaatccttactgaggctatacagagagccaatgaggtgattgagaaaagagccggagaagatgaacggttttccggtatgggaacaacggttgtagccgcctgctgggatggaaaagagctcattgcggctaatgtgggagacagcaggctttatgtggtaaatggtggaattgagcaggttacggaggaccattctctggtacaggaaatggtcagaattgggggcatcaacaaggaagaagccagaagccatccgaataagaatattattacccgcgcggtcggactggaacaggatttaagtgtggactgcttcaggcggcctctgaaaccgggaaatattgtgctgttatgttcagacggcctgacagatatgctggaggatgaagaaatttaccggattctcaccggtgagggaacgattcagcaaagggctcaggccctggtacaggcggccaatgacaatggcggcagggataatatcgcagtgattgtgatagacccgttttcataatgtatgcagtggggtagtgtgcatgccaagtggaggaagaaggaaccgccgccgggcgattctatttttacctgtcgggaaagcagcgtattttccgggcaggcaggaggactggaatgattaaaattggaatgatgctgggagaaagatatgaaatcctggaaaaaatcggcaccggcggaatgtcggacgtatataaagccaaatgccataagctgaaccggtatgtggcggtcaaggtgctgaagcaggaattcagtgagaattcaaattttgtatccaaattcagggtggaggcccaggctgcggcaagcctgatgcatcccaacattgtaaatgtttatgatgttggtgaggacaacggcatccattatattgtcatggagctggtggaaggaatcaccctcaaaaaatatatcgagaaaaaagcacgtctttccgtaaaagaagcagtcagtatagccattcaggcgtgtatgggcatcgaggccgcccataataaccatatcatccatcgtgatattaagcctcagaacatcatcatatcaaaagaaggaaaagtaaaagttacggatttcggtattgcaaaggcggcaaccagcaataccattacttccaatgtcatgggaagcgtccattatacctcgccggagcaggccagaggcggctacagcgatgaaaaaagcgatatttattctatgggaatcacattatttgaaatgctgacaggacgcgtcccttttaacggggatacaacggtggcgattgccattaaacatatacaggaacctatgccttcacccagggactatgtgccggaaataccggtgagcgtggagcagattgtgctgaaatgtacgcagaagagcccggatcgcagataccagtccatgagttcgcttattgaagatttgaagaaatccctcatctcacccgatgaagattttgtccggacagtggatccagaaacctctgccgccacccgtacgatttccagggacgacatggagaagataaagaaacagtccaaaaagcctgcccatacggaggaaatacggctgaaaaagaatactgcaaagccttccgcggagccttccagaaacggtaaaaagagatcccaggcagcatatcagccggagcctgaggatgacgaggatgaggaagaatatgaatcccggatggaaaaggtaactacagttcttgcggttattggcgctattattatcggatgtgtggtgatcttcctggtaggaagggcaatcggtatttttgatttttcttcttccggacaggacggtgtggtaaaaatgatcgaagtagccggcatgacggaagcggaagccaggcagaagctcactaagatgggactggatcccgtagtggagtatgtggaaagcgacagtgtggaggacggtatagtcatcggttcggatgtgaagaaaggaacacagctggaacccggagacaaggtggtgctgcaggtgagcggcaaggatgccggaatcgtggtgcccgacacctataacaagccgcttgcggaagctgtggcctccctggaaggggaaggcttccggacagaaaagaaggaaggctattccgataccgtcgccaagggaaatgtcatgagccagaatcccgaggccggaaccaatgcggaaagaggaagtacagtaaccatagtcatcagccagggacctcaggagagcaaggtgcaggtgcctgacgtattaggactgctgcctgaagaaggcaagagtacggtggaagcagcaggtcttaccgtccgcaatataacggaagtatacaatgaagatgaaagcctgctgggcaaggtatgtggcctgagctattccgtgggaacggaggttgagccgggaaccgccatcgatatttatgtgagcaaaggcccggaggctacttatatctacgcggagaatatagcgagtcctgcattggaagatccccagtatgcggagggaacgccctgcgttcttgtggtgacgacagcgtccggtacggagattgcccgtacggtggcaacctccttcccgtggccgctgaacctgccggatatcaaagagcccacaggaacccttaccctgatttacaatgtagccgccgatccgatcaccactacggatccggtaacgggagaaacgaaggtggaacccggcggagtccaggagaagaccgtgaccaggccgctgcagtttttgaagaaagagtaagtgcatgaggggaagaataatcagaggaatcgccggtttttattacgtacagaccggaaatcagatatatgaatgcaaggcgaaggggattttccggaaggataagaaaaagcctcttcccggagattatgtggaaatcgatattctggatgagacggcgcttaccgccaatatcagcgttatactgcccaggacgaatgagctcattcgtcctgcggtggccaacgtggatcaggccctggtcattatggcggcggcaagtccggctccgaacctgaatctgctggatcgctttctggtgaccatggaacagcagaaggtggaatgctgtatctgtttcaacaaacaggacctggtagatgaagaatggaaggacaaactcagggaaagctacaggaatacgggctaccgggtattgtttaccagtgccaggcagggagaaggcctggaagagctctgtcagatacttacaggtaagacaacaacggtggcgggacccagcggtgtgggaaagtcctctctgatcaatcggctgcagaccggcatttccatggaaaccggtgaaatcagcacaaaaatcgaaagaggaaaacataccacaaggcattccgaactgatttatgtcagcgaagatacctatattgtggataccccgggcttcagttctattgagctttatgggatggagaaagaagagctccaggattatttcccggaatttgccgattgggagcctgaatgcaggtttaccggctgcgctcatgtgaaggaacgtgactgcggagtgaaaacggcgctggagcagggagagataagccggagcaggtatgagaattactgccagctgtatgaggaattgaagaataaaagaaagtattgattgattcctgccggctgcgagccaaatagaccgggaagatgttactgaaaatgagaaataacaggaaagagatggatatcgaaaaccatctctttcctgttatttatagcgtaagtatatatattaaagcaaaacgaccctgccgttacccgtcactcaatgaaacgctcttgtcatataccttccatataccattcccaagcaggtctttgcatctatctaatgtatagcggggcaccgccagctccggcagttcggaaagtcttccttccagataatcctgaagccggtcggaggctgtttccaggcgggcgagcagcccgccataccgcagatccaaccgggaccagccgaagggggagcaggaggacatccattgctccctgtgaagccttcgtagttttttcacacgaacatacagctcggacagggcagcagcatcctgctgcagagccgtcatgtcatgctctctgtaatgccaggaaagggcgccgctcagggcgctttttatttcgagcacttcggccagcgccagaggcacatgcagaaaagctccgttttctccggcttccgcaagatcgcgccgcagaagctgtgccgtcctgcggtaatgcagatcaagggagaggccgcggatatccgcgtcgtagatcccctccagaggatcctgccataaaatatatttgcagggattgggcggccatcggttttccggattgatacaggggacctcatccaggagggcggcgtctctgaaccatccggcatccagaccggtacaggcaagaaaccgggaatctaatgaaccgggatccacagctccctctgtataggcgtgctccgcgtaatactgcatcccgggaaggcccagccagtcgctgcactctgcgccgtcatcgtgccacagacagccgtatgccatagggattttctgcctcttgaccgccatgagcgccgggccggccgttttccaggtggcttcgtactgtacgcagaaagaagaaacggagagcagaggcccggcataaacagtggggccgatgctgcggtgacaggtgagcatatcattcagcaaagatgcctcccgtgaataataatcccagtaaatgagctgtgcatcagagggaatgagttcctttgtcctttcatcaagctgcatatgaggatccaggtaggtatgcttctctgagccgtatttaaagagcatgtcgctgtagaatgctatattcaggccatattttccggccagagcgtgtacgcggttcaggtgttccagatatatttcaatgggaggcctcaggccgttcagaacccggtagcgtccttcgcccagcccatgggtttcgtccattccgacaatgatctgccggctgcgcaggcatgaccctatggaagacagcattttacagataaactgttccgtttcctcacttccggcaagaaggcaggaggaattgtcccgaagcccggcatattccaggaaacgcagcaccttttccatatgtcccaatacctggatggaggccacaattcggattccatatccggcggcatagtcgtcgatgctgcgaagctgttcccgggtatatccgcctctcatataaccgaatcggggttctccttcgatttcatagacatcttccatatacaaaatcaggcagttaagccccatgagggccatacggtccagcagtgactgaaggaattccggcgacggtacgctgttgcgggatacatctgccataatgccgatctccggtatgtacatcttttgatttatgaaaaagtccttttcttcagcgtgttccttcagcaaacccagtccccggaacagatggacaggcagccggtattctattcggcagccggtgctgtcccgtgtgactgtgagatcgctgccgtcctgtaacgatggtatcggacagatagtgagatggatctcctctgcccattttccttcccagaagaaggagggaagccggttaatacatgaaagtaattctttgtccgcgcctgtaattgatgcaaacatattctttatctcctttattcaaataagacttcagagagcacggcccggggcagctgtccggttatcagccgtcggccgtcactgtaaccttcttcacgcccttccagttcccggatcagaatcgagcgcagtgcggcgatccgttccgcacaggccggcgcctgtatccggtttttgacttctccggggtcggcttttagatcaaaatactgttcccgtcctgtctgggaataccagatatatttatcgttgccggtaacaataaaatgattggattccccgccaaaagaatgctcgccgtgaagataatcccgcgtttcgcatccgccgcccggaagcatgctgcggccgtccaaagatgccggaatatcagcgcccgccaggttgagaagtgtaggcatgacatccctcagctcaacaagagaagaagataccgtctgcctgctgcccagcagccgttccggtccatgtatcagcatggggatatggatactgctctgatagggatagcttttgcgcaccagattatgatcgcccagcagttccccgtgatccgaggtaaaaaggatcacgttgtcttctccggcgcattgtgcgtgcagtgcatccagaaagcggcctatctgatgatcaatatgggtgatgcatgcataatagccggcctgctgctgcagttcaagttccggatcggaaggagtaaaatgggaattgtaggttctgccctcaattcccggatcctgtggatcccagtccccctttaccggaggacgcagcggccggttccgatagagatcgaaataccattggggtgcgtcatagggggcgtgaggacgcacaaaagaaagcatgaggaagaacggcattctccggtctctgcgccgcaggaaatctatccctctgctcacaacccagtttgtaggatgaagtgattcctcataaggccagggacgcgcaacccaggaattgcagttcagaccggtatcggatacgtcacagtccggcccgcgcatgcagtgcagccagtgatagtaatcatcggcaatacgctgatcctcgtaatagtccgtgcccggacggcggtaaaagtccaggttcccgtcatggagctcaatatggtggaagcccatcatgctccgcaggggatgtacatgcatttttcccacgcactgggtgtaataaccggcctttgacagttctcccgccatggtgacaggatagttccagtcgattccgtcctgatagccgactctgccgtgctttttttgagacaggccggtgtgcagggccgcccttgccggtacacagcttgggcaggcggtataggcattggggtaaaaaatgccctgggcggcaagggtatccagatgaggtgttttcacatcaggatgtccggcgatgcccaggcaatcgccgcgcatttcatcagtcatgatcagtatcaggtttggtcttttgctcatttgttttcagtcctttctttttagcggttgccgggttcatatatacggaacggtattcgctgggggtcatgccggtctgtgccttgaatttacgaataaagttgggagcctgggaatatcccaggcttaaggcaatttcacttatggtaagccgggtgccgatgagaagctgacgggcgtaatcaaggcgtttttcgctgatataatctgaaatgttcataccggtctgggatttgaagcgatggctcaggttggaaaccgacaaaccgaaaacctgtgccacttggctgacattcatgtcctcgcggctgtaattttcattaatgtagcggataatctgcatggctgaatcgggggcgtcttcttcgggctgggcaagctgtgtgagcagctccaatgcctgccgggtgatcgtctttgccgtttccaggagaaggacaggatccgtttcccagcgcagggaggaatatacctcctgcagcttcagggagcagggctgaagttcgcgcatgccggtcaggctgatattgatgatgtcacagcagatggaacaggcggtaaagggctgcagagaaccgttctgtaccgtatccatcagggtgtctgcaatcagctggtatcgttcgggatcggtttgaaccagtgcataatacagcgactgaagatcgagagtgggataggtgaaatcctccttttccagcccggcttcctcgtaaaaacagatatccgggccttccgccatgctttcatgcagcgacagcgcctggcggaaggaatggttcagcttacgcggattggaatagcctttgcccacagtaatccggacggcctgtccggtctgctcggtgataagggcacaggactctgtgagtgcctggcggagcttttcgcggcttctggcatagcccagcagaaacagataacatttgcccgttatatattccatcccggataccgggcaaagggcttcaaggctgtgtgtcacagcttccataaccgcttccttgggtaccgcgcccacagtctgaagaaccatagtacagtagctctgttcgttgggaggcagctccgccagctgcagacattccgatacggaaggatcatcctgcatccgcccatagattaatttgaatatggccctttcccgaaggacggatctgcgcaggctgctggtctgacgttccatgctttccagcgcatagcccacggctctggttccctgcagttccctggggatatccgatacacgccgtctggcggattccgacagacggcgaatcgggcgatagttgaacattgccataacaaagaccaggaaccctccggccgcagccagaagcagaaaaagcaccaggaataacctttgggcctcctgcacaggggaaaggatgacctcttccggaagaagaagggccagatacatgcccgattccggggaagagcggcagaagaggacccgtccgtcagggagtctgacaaagggttcggaggattccgagatctgctccgtcagcaaaggatcaggaacaaaactggaataaagcacatccttttttccgtacagaatcatataatcggtattattcgccagtctgcggaagctgtgctccgggactgaaaaaatcacataatcgccgggagtgtggggtatgggaatgatgcagtcataggaaaggccctgaaatcccgaggacataagctgctgcccgggggtgaaccactgttcatccgtaatttccggaagtattcttttcagatccgccaaggtaccgtccggaagataatattgtttataaaaccgtacattgaaggttccgttattcgtatataccgtatcgggggaagccgaactgtaaaagctgatggtcgtgaaaaaatcctggggtgaaacaatactgctgagcacgttcatggtgcgcgaatagccgggcgcatcttcaatgatgtcttcctggcggaaggtgcgctggttggtgaactgtccggcgatattgcgcatccattggacatgcgtgactatctcgcgatccagactgacgatttcattctggtagcgttcgaaaacctcattttgatagagagaaagaaaatagcggttgtagataagaaaaaatgtgacaagaggaagcagcagtacgagaaggaaactcagcaggtaccgaagaagcgtattgtctaataaagtgccgggtttccttctcattgtgtaatttcccctttctgctgcggttaaatatagtgatatttcttaaaatatattttataagaatcagaatttgccgtccagataatcctgctgccactgaatccattcactgtagcggtatttctccaaatccgccacatgctgttcccaggaagcgtccgtaacaccgttcattatggcatttgcggtaaaattcttgatgtaggagagcaaatccggttcatagacagctttggaaagtgtggcttcttcagtggcaatacggcttggcataagcccttcgtcctggatccatttttccactgcggtaacgtaaccgtcacgtgcataattctgcggagaagtctccggatcatcccatgccatttcatcaggataaagaagaacgggacacgcctgcatcagtccataggtataacaggcattctggaaattgaagtccggtccctgatcctggagctcatatattttgttatctttcatttcccacataacccctttttcgcctatgcgggccgtctgtttcagttccacggagctcgccatataatcataccagcgtaccagggcttccggatttttgcaggaagaggttatcaccaggccgttaatgattcccataaaacgatcttttgtgccgtatactgtttctttgccttccagcccgggagccgtcatgggaagaacctgtacgtactggtcggagagttccggatcgtcgatgatggtgtctggcgtccatgcatagaaagaaccgtaaagcccctgtttggcttttgacatgaactgctgatcggtctgtgaaaagccttcgatatccagaagtccttccgatgccagcctgtggtaatattccagaaactgacggtattccggtgtgtttgcggtaggaatgactttgccgttttcgatgcggtagttgtcattgaagccgaaagcccccataaactgaagcaggcgggcctggaaattattttcgcagtagcccagaggaatttcatcattcgggtcgccgtttccgttggcatccatttccttaaaggctttcagcacttcataatattcatccagatttgtggggatatccttgcctacccgatccagccagtctttattaatgaattgtactccgattgtccagcttttatgctgtgtgtagacgctggacataaagctgtagatgttcccgtcagggtaggtgagcattttcagggcttctccgtttgttttatcgtaggtttccttaatattaggggcatattgttccatcatatcattcaaaggaacgaaggacgcataatccttcatgatatcggaaggatccaccatacccatgaatgcgtcaggcatatcagtggaaagcaggatgctcagctgttccttctgcccttcacctgtgggaatgtctatccattctatatggatgttggtagcctcttccataagcttcataatgggtttttcgttggtatccgtgctggaatcaaggggatttttgccgcgggcgatgcggaaggtcaccttttcattgacgatgggcagccctgatgcataggtatttccgtctgcaagcagcgtccgttccccggatgaggattcctccgccggggcggctgaaccggaatcggcaggtgcttcgggaacggaatcggaaggagccttgttggctccgcagccggctaaaagactgcaggacatggtgagtgtgagcagaagagcggtcagtcttaatttctttttcatggaaaatcctcctttttcatgggaatattgatgaatcagcctttgattgagccgatcatgatacctttgacaaaatatttctgtaaaaacggataaacacatataataggaaccgtggaaaccacaatcaccccatatttgataacctcaaccatgcggttgagctgggctgccgcctggggatccatttccgtaagtgaggcggtattctgggacatgagaagaatttctctcagataaagctgcagcggctgctttgccctgtcggtaacatagatcatggcgttaaaataggaattccagtgcgctacggcaacatagagcgcgattaccgcgatgatggcttttgacagcggaagagcgatccggaaaaaatatccggcattcccgcagccgtctatgaaggccgcatcctgaagctccctgggaagagtattggcaaaaaaagaacgaatcaggatgatgttgtatacggatacgcttcccatgatgatcagaaggatccgtgtgttggtcagatgaagacctttgatcaccagataggtgggaatcaggccgccgctgaagtacatggtgaataccagcagggccatcagaatatttctgcccggaagccgtaccgcggagagcgcatatcctgcggggacgctgacggcaagcccgaaaaaggtaccgcatgcggcatacaggatggtgtttgcatagctttgccagatgcgcatatcccggaatacctgggaatatccgatcgtggtgaagcccttgggaaagagcagcatctctcctgaattgacatagacgggctcggtgaaggaagcgattaccacaaagtaaacgggataggctacaatcagcagaaaaaggagcagcaggagccttgttataatgataaagagcttatcttcccatccggattttatgttgttttttgttttcatgtaacacctctttctcaccaaaggctggaaccggaaagcctgcgtgttattctgttgacggttaccagggtaataaagttgatgacattgttaaaaagaccgatggctgccgagtagctgtaattttgctgaataagcccgaccttgtaggtataggtggaaataacctccgatactcccagattgaggttgttctgcataagataaaccttgtcgaaaccgatgctcatgatgctgccgcagtttaatatcagcaggatggccatggtaggcatgatggcaggaaggtcaatgtgccagatacgctgcagcttattcgcaccgtctatcatggccgattcatgaagttcggggctgactccggtaagggcggccagataaataatcgaaccccagccggcgccttgccagactcccgaccagacgtacatatgacggaaccagttctcactgcccataaaatagacaggttctcctcccagcgccttgattgccgtgtttacaaagcccgactggggagaaaaaaaggaggacatcataccgactaacacgactatggaaataaagtggggcatataggtcagtgtctgggagatgcgctttaatttggaattctttatatcattcagtatcagggcgagaataatcggcacaggaaatccggcgataagggaatacaggctcagatacacagtgtttcggacgtaatcccagaattttggattttgaagaaacatggtaaagtaagtcagcccggtccattcgcttccccatattcctttggacggaacgaagtttttaaaagcgatttgaaccccatacatgggtgcatacgcaaaaataccgaaatacacgaaagcgggaacaagaaaaagatacagaaccctatttgattttatcagcttccaggtttctggctttgcagtgtactctgccggatgatgtcgtttcatattaattctcctttcggtgcggtttaattccggaatttcaggctccggcaatccggggcatccacatgggttcccgatccatttcctgccataaagcatgtaacagcagcttttccttcaaatcccggtaatcaggatgaacccagagattatgcgattcgccgggatcttcagccaaatcataaagctctccccagtcccggtctgcgtagacggtgagcttataacgttcgtccacgtagcagcgctgctgaagggaggagggttcctggtgattttcacataatacataccggcgggcggcttcttcatttcccatccatacctggcgctgattgacgccgctcatggatggagggacagggagcgaacaaaaatccagaagcgtaggggccaaatccaccagggactgcagggaaccgcaggtccgtccggcaggaacctccggcgggaagcggatcagaagcggaacccgaatcagatcttcatacaaaaagggccccttataatgaaggccgtgctggccgaacagatgaccatgatccgtagtgaaaatcacaagagtatcctcacataagccaagggtatccagccggtcaagaagtatacctgtgcagtaatccagataacttatcatgccataataaacctccatattccttctgatctgctccggggcgatgccggcatgaaatcgcaggccatgcagaaattgtccgctttcccggtaagatgaccagtcggcatcctcctgctgagtcatggcaaaatgaggaggaaagttcataaattccccgggactgccttccggaaccgtcaggggagcaccggtgtacatatcgcaccagggggatggcgccagatagggcggatgaggatccggaaagctggcccagagaaaaaacggtctgttttccctccggaagcttccgagcagatcgcagcagcgccgggttatccaggtattatagtggtactcttcaggaatttcccattgataaaggctgttggccgggagtgtgccagcaggaggtgaaaagtattctctccattttcccggacactgttcctccagccagagagcatagtgctgtcccaccagatattcacaggtatggtttctcatcagctccacatgttcgaatccatagaagggtccgtgaaaccctttccagaaggaagagtcatatagaagcggttcagcttccaatgaagaaaaggagtctgtggaggctttgggctgaaagtgggctttcccaatgagagccgtccggtatccggctttctgaagatagtcccccagcgcgggaacctgttccggcagctttgtcccaagcgaccaggctccgtgctgtgaaggatacaggccggtaattatggatgcccgggaaggagtacaggtaggattgctgcagtatgcacggttaaaaagtgtcccttcacgcgccagcctgtcgaggttcggagtatgtatttccgggttgcagatgccaagcgtattataatgctgctgatcgcttgtgattagcaagatgttgggactatgcatataattgctccttttttacaaatgccggatggtaaaatggacgaagtaaaatccggccgactgaaaatgtttgtgtacttttcgcgtttagtatagcatttaataaatgaaaatgtaaattatcacttattgaaaggcttctcataatttgaaaacatgaaaaaatacccaacaaaacctgtaaatagacaacaaatttaacattattttaaaggagaccgatggagtagttaccgtggtctgtcagggcttacactgcagagacctgtcatcaagtaagcattatttcttgactaaatggaaaaagaagtttatactaaaaataccgaacggtcggtttttaataaaggaggcaatctgcatggcaaaaaaatacaactcacaggcgactatcgaagcgatcctgtctgtttctgcaaggctgttattagaaaaaggtttcgataaaacaagtatgaaggatattgccgaaacagccggtatatcaaagggagctatttatcatcattttcagtccaaagatgaaattatagaagctgttatggaaaaacaggctcataccgtcacagctgcaatggagggctggttagctgatgcggattctctgaacggcagagaaaagctgcagtttcttctgaaaaagaatatagaaagccaggaagcccattgcctggacgatatattgagcgcccgcatgaaaagcgcggagttcgtcttgtcctatatgcaggattgtgtaaataaagactctgcatttatttctgaaataatgaaagaggggatagctgacggctcactctctacagagttcccggaagaatgtgcggaagtttttcttctgttgatgaatgtatggtgtgatcctgctgtatttagcggcaatgcggggaagctggagcagcgtatgcgttttctgcagcacatgatgaaggctgttggaattgacattttgaatgatgaactcatggaaaaatctttgcacttaatacaaaaaatatatgctgaaaattaaaattttgaatggttaagcaatattatggaggagcagtaaatggaaaaagtattggaaaatgcaatagacaatgggcttgggagaatatcgtccggtctttacctgttcagtatcgggctggggattgtactcataatactaggtgttatccttatttttaagaacagaggctcaaaggaaaagaagaaaacggcaaacgtcgggctgatctgtctccttatcggcatagttgctgttataagcggatgggtgcagctatagagaagatatgatacctgggaaattcctttttagatgcttaaaatccatatctgaaggaaatttggctattttcaaaaggctggctatgtgatataattttaagctgtatcaaatcgaaaatataattcgattgataaaaacagtagtaacaaaaagacagtgtaataaattgtacagcataactatatagaaaggcagaaaaccttgcatataatggatttctggacaggtatcatcgaaaatgaaattaggcatcgtaggtcttcccaacgtaggaaagagcaccttatttaattccctgacgaaagcgggcgcggaatccgccaactaccccttctgcaccatcgatcccaatgtgggaatcgtaacggttcctgacgaaaggctgaagcttctgggagatatgtaccattccaaaaaggtaactcccgcagtcattgaattcgtggatatcgccggtctggtaaaaggggcttccaaaggagaaggcctgggcaaccagttcctgagcaacatcagggaagtggatgccatagtacacgtggtgcgctgctttgaagatgacaatgtagttcatgtggacgggaacataaatcccctccgtgatattgagaccattaacctggaactgattttttccgatatcgaaatcctggaaagaaggatagccaaagtgggcaagcaggccaggatggacaagactgctgccaaagaagctgcccttctggaaagagtgaaggctcttttagaggacggaaaactggcaatggcattccagcccgaggatgaggatgaagaaaccatctttgcttccctgaacctgctgacggcaaaaccggtgatttatgcagctaatgtatcggaagatgatctggcggatgacggggcgtccaatgcgggagtggcggctgtcagggaatatgcggcggaaagcggaagcggtgtttttgtcatctgtgcccagatcgaagaggagatctccgaactggaggaggatgaaaaggctatgttccttgaggatcttggcctgaaggaatccggactggataagctggtaaaggccagctataagcttctgggactcatcagctttttgacctcaggcgaggacgagaccagggcgtggacgatcaagattggtacgaaggctccccaggcggccggaaagatacataccgattttgaaaggggctttattaaagctgaagtggtgaattataaggaccttctggagcagggctccctggcagcagcgagggaaaaagggcttgtgagaatggagggcaaagaatacgtggtacaggatggggataatatcctgttccggttcaacgtgtaagataataagtgctgtataaataaatagaaaaaccagagccatgttgttcctgtttaataataggaaacaacatggctttttctgtgtcggcagccttttatggatcggagttttatggcggctgtcaggtgtgttgaaacaggaaaaatgcttactgatggaattatttacaggaaatcggaataattccagctgaaaatgatgaaaatttgggattatccaccaccgtggtaaatactggaaacaaaaaaacaaaatgaatacataaaaaccatatatagtatatcgaaaaaggatgcataccatatatagataacatgccaaaaagcaatctgcagagtcaactgccggttgcttttttttgaaggaaaggattgattttgcttgcaaaatgcattagattatactaaaatcaatataaaagtggtggaaagtggtgcgaagtggtgggaagtggtagatttcctccggctggtgtcagttatcctgcggacaaggcggcttcggcagtgctttttgtgtgacaggccacttttgaggcggtgattgtcatgttcatgggtgaatacaatcatacaattgatgcgaaaggcaggctgatcataccttcaaaattccgagaggttttaggcgaggaattcgtaattacgaaagggttggacggctgcttatttgtgtatgacaatcaggaatggaacgcctttgaggaaaagctgaaggctttgcctctgaataagaaggacaaccgtcagttcgtccgtttttttcttgcgggagccgctgaagtggaagtggacaagcagggaagaatcctggttcccggtaatctgcgtgattttgcaggactggaaaaggatgtggtactggttggcgtggccagccgtattgaaatctggagcaaggcgaagtgggacggcattacggaagatgaagatgaggcgatggaagatatcgcagaacgcatggccgatttagggctgggaatataagagacaggaaggttgaggctctatggaatttgttcataaatcggtacttttagatgaaacaatcgaaggacttgccataaagcctgacgggatctatctggacgggacgctgggaggcggcgggcacagcagtgaaatctgcagaaggcttgccgacggacatctgatcgggatcgatcaggatgaagaggccctggcggccgcatcggaaagactgaagccatttcaggataaaataaccctggtacgggataattactgtaacgcgccggaggtaataaagaaccttggaattacgggagtagacggaattgtgctggatctgggggtttcctcctaccagcttgacaatgtggaacgcggtttttcctatcgttatgacacggccctggacatgaggatggataccaggcagtctcttaccgcaagggaaatcatcaatgagtatccggaaagagagctctaccggatcatcagggactatggggaagaccagtttgccaagaacattgccaaacatattgcggcagcgagaaaggaaaagcccattgaaactacgggtgaactgaacgaactgataaaggcggcgataccggcgaggatgagagcgaacggaggacatccctccaaacgtaccttccaggcgatccggatcgaatgcaaccatgaacttgatgttttgaaaaattccctggatgagctgattgcaatgcttaatcccggaggaagaatatgcattatcacatttcattccctggaggatcgtatcgtaaagtcggccttccgcaaaaatgagaacccgtgcacctgtccgccggatttcccggtatgtgtgtgcggaaagaaatcccagggaaaggtgataacgagaaaaccggttttgccgggggaggaggaactggaaacaaattcccgttccaagagcgcaaaactgcgtatttttgaaaaagcggccggataagacagccggtgtaacagataaaggagaattgccatggcgcagacagtaagaagcagacaaagcagaagtactggaaaaagcgaatacagaagatcagtcagccgcagtgcatatgtggccggcaatacggtaagacaaatagatgttgttgaagaaatacataagccccgcagacaggaattaagccatgcggtaaagaaaaacagggacaaggccgtttatatgaacctgggatatgtactttttctgacggcttctctgattgtggccggcgtcgttctgattggatacatccgtctgcagtcggaaatcactgcaagcgttaagcatattgcggcaatggaaagcactctgaacagcctgaaggtttccaatgatgaggagtacagcaggattgaaagctctgtggatttggatgagatcaggcgaatagccattactgaactgggtatgacctatccggatcagaaccagattgtaacaattccggatgaaggcagcgattatgtgaggcagctggcagatattgcagaatagaagtgggtggcagtttggacagaaacagagaaaacaacgatagaaaagattcgcagaacacaaataaatttacaacgaaaatgcaaaagaagctggtagtactgtatttcctggtattactggcttttgcaggattaagcgcaagacttgtcttaatcaaccgggacaacggcgaacagtataaacgccaggtgctttcccagcagcagtactccagccggacgctgccttttaagcggggagagatactggattccaaaggaaccaagctggcggtgagtgaaaaggtgtataacctggtgcttgactgtaagctgatgaatgaaaaggaagagtatgtggaaggaaccatcgctgcgctgactcagtgttttgatgtgtcggagtcggatatccgttcctataatgagcagaatcccacttcacagtatcatgttttgcaaagacagctgacttatgatgagatcgcacccttccaggagctgcagaataatgaagagcagggaaagtacattcagggcgtttggtttgaagaggaataccgcagggtatatcccaataataccatggcggccgatgtggtgggttttaccagcaaggataatgtgggcaactatgggctggaggagtattataatgatattctcagcggcattaacggcagggaatacggctatatgaacgatgattccaatctggagcggaccacaaaggccgcggtggacggctataatctggtgactacgctggatgccaacatccagggaatcgtggaacgcaagctgcaggaatataacgatacctataaaaatgcggcaagagaaggaaacggcgcccagaatgtgggctgcatcatcatggatgtaaataacggagacatcctggcaatggccagttatccgtttttcaatctgaacgatccccgtaatacggacatgctgttgggacagcatgtggtgaatgagcagggaacggttcaggatactataattaatgaagaaacgctggcaggcttcgatgatgatacgctgtaccggcagctcaatgctctctggaaaaattattgtatatccaatacctatgaaccgggttccaccatgaagccttttacggttgcggcgggactggaaagcggcaagctgacgggaaatgagacctatcagtgcaacggaagcctgaccattgtggaagggcagaagccgattaaatgccatagctaccggacaggcggagacggtctggtgacggtggaaggagccattgaacgttcctgcaacgtagccctgatgaaaatgggacaggccatagggaaaaccacattgctgaaatatctgcaggatttcaatttcggcctgaagaccaacattgatctggcaggggaagcccgtacggcctccctggtatttacagaggaaagcatgggccccgtggagctggcgacggcttccttcgggcagggctttaatgttaccatgatacagatggtggcaggcttcagttccctgataaacggcggttattattatgaaccccatatggtaagcaagatcaccgcatcggacggctccgtagtgagaaatattgaaccccgtcttttgaagcagaccgtatccgaatcaacctccgcaaagatcagggattactgcaaggccgttgtagtgggggaaaatggtaccggacatacggcccggcccgccggatatattatcggcggaaaaacagggacggcggaaacacagccccgcggcaacaatcaatacgtggtttcctttatcggctatgcccctgcggatgatccgcgcattgctatctatgtggtcgttgacaggcctaattccgataaacaggacgatgccaaatatgccacaagaatcgtgaagagcgtgctcacagaggtgctgccttatatggacatttttatgacagaacctctctccgaagcagaacagaaggaactggaggaacagcagatcgcctataaacagcagctgatgagccaggtcagcggcaatgatgtcagcgataacgatgtaggcggggaagaaggggaagaccaggaaggcggccaggccggagaaggctcccaatccggtgagggcacgggaaatgaggaggacaacgtgaacaggccggcgatggaaattgatccggaaaccggatatggtattcttcccgacggcacgagagtggatcctaaaacaggggatgcgatagatgaggatacgccgctggatcttccggaacccaacctgcctttgaacgatggacagaaccagggggatgaaggcggagacaattcaccattctgataattggtttttccggaatcttttcatacaaaagaaggttaaaatgagaataacctcataaatccggtaatagattgtatcaattaccgctttatgaggttttccaatggaagagaagaacaaaacattccacagaaagaaaacagtctgggcctttgttatctgtctggcggtttttgtggcactgacagggcgtcttgtttatctgatggtttatcagtcagcatattatactcaggcggcggaggaactccatcagagggaaagaaatatcaaagccaaaagagggaggatcattgacgcgaccggtacagtgctggcggataacagaaccgtatgcaacatttccgttatccataaccagataaaggatccggacaaagttgttgagatactcgccagagagcttgatctggaggaggattatgtcagaaaaagagtggagaaatacaccgccattgaaaagataaaaagcaatgtggacaaagcggtgggggatgccatccgtgcctaccagctggacggcgttaaggtggatgaagattataagagatattacccctttgacagcctggcttccaaggtgctgggatttaccggcggagacaaccagggaattgtggggctggaagtaaaatatgatgaatatctccagggagaaccgggaaccattttgacagtgacggacgccagaggcgtggaggtgacgaaggaaggggaagaccgggtggagccggtcaacggtgacgatctccatatcagcctggatgtgaatattgaacaatatgccacccagcttgccaatcaggtgctggcggcgaaggaggcggagagtgtttccatcctggtgatgaagccggacaacggagaaatcctggcaatggtaaacgtgccggaattcaatctgaacgaaccgttcaccctgccggaaggcacggcggcggagggtttgtccggaaaggaaaaacaggatctgctgaatcagatgtggcgaaacggctgtattaatgatacatatgagccgggatctatttttaaaatcatcactgccgcagccggactggaggagggcgtggtgactatggaagatacattcagctgccccggttatattatggtggaggatcgcaagatccggtgccataaaacctcaggtcacggggcagaaacctttgtccaggctaccatgaattcctgcaaccctgtttttgttacggtggggctgcgtctgggagcggacaattattacagatattttaataagttcgggcttctgaacaaaaccaatgtggatttgcctggagaggccggaacgatcatgcacaagctggaaaatatcggcctggtggagctggctaccatttccttcggccagtcctttcagataacgcccattcagcttgccacaacggtatcctccctgataaacggagggaaccggattacccctcatttcggggtggaaaccatggatgaggaaggcaatgtcacgaataccttcgaatacccggtcacgaccggtattgtatcggaggacacctgtgagaagctgcgttttatgctggaacaggtggtggaaaacggaggtggtaagaacggatatgtggaaggcttccgcgtgggaggcaagacggcgaccagccagacactgccaagaggcaccgggcgttatatcgcttccttcctgggcttcgcgccggcagacgatccccaggtgcttgccctggcaattgtgacgaacccgcagggggtatattacggcggccaggtgtcggctccggtggtgcgtcagctttttgagaatatccttccttatttggaaaagttggattataatgtacgagaacagcagggaaattgaaaggaaagggtgacaagtgtacttattgtacacggagagtcacaggaaaggttaaatgagtttatccgtttgtataccggtgctcctgtcgtttctggtaagcgtattgctgggaccggtaatcataccttttctaaagagacttaaggctgggcagaccatcagggatgaggggcccaaaagccatttgaaaaaaaacggaacgcctacgatgggcgggattttgatcctgtcggcaatgattgttacctctcttttttatatgaaggattacccggaaataaaacccatactcctgctcacgctggggtttgggctgattggatttctggatgactacatcaaggtgattctgaagcgttccatggggcttacacccctgcaaaagatggcgggacagctggtggtgaccggtttgtttgcctattatctgctgaaggttacagatattagcctggcggcgaagattccctttatgccgggagtggagctggatttgggatggctgaatataccgcttctgttttttattataataggaacggtaaacggtgctaattttaccgacgggcttgacggcctggctgccagtgttaccgtgctggctgccagcttcctgtctgcggcggctattggtacggggacgaggatcgaacccattacctgcgcggtggcgggagccctgatgggcttcctgctttttaatgtatatccggcaagcgtttttatgggagataccggatctcttgctttagggggatttgtggcggcatctgcatatatgatgcagcttcagctttttataccgataatcggttttatttatgtgatagaggtggtgtccgtcatccttcaggtcgtgtatttcaaagtgaccgggggaaaacggttattccggatggcgcctcttcatcatcattttgaactgggcggatggtccgaaacaaggatagttgcagtattttccattattacggcgattctgtgcctggtggcattaatagccatgtaaaacgcggcggtgccgcttgggaggtagaaaatgaacgttgaaggtaagaaggtcttggtagtcggcaccgggaaaagcggtattgcggctgccgcactgctggcaaaggaaaaagcggcgccggttttgtttgatgaaaataaggatacggatgcggaggaagtgaaaaaaaagcttcctgatgcggagatagaagtgattaccggaactcttccggaagggattctggatgaactggagctggcggtattaagtccgggcgttccggtggataccccttttgtggaaaaattcagggacaagggtatccctgtctggggtgaagtggagctgggctacgctttttccaaaggaaaggtgatagccattaccgggacgaacggaaagacaaccacaacggctcttaccggtcagatcatgcgggattattacgaatccgtatttgtggttgggaatattggaaacccttatacgctggaagctttgaataccagggaggacagcgtgacggtagcggagatcagcagtttccagctggaaaccacagtggatttccacccgtcggtatcggctgtcctgaatataacgccggatcatctgaaccgccatcataccatggaaaactatgcggcggtaaaggaatccataacaaagaaccagacgaaggaagatacctgtgtccttaattatgaggatccttatacgagggctttcggagaacgctgtccggcatccgtcatctggttttcctctgctgataagcttgctgagggctattatctggagggagaggacatcatccgcagcttcggaggcgtgacggaaaagctgctcaatatcaatgaaatgaagcttataggcacgcataatgtggaaaatgttatggcggcgattgccatgtcggcggcatacggagtgcccatggcgaatataattaatacggtaaagcattttcaggcggtggagcaccggatagaatatgtggctgaaaaagatggggtggtgtattacaatgattccaagggaaccaacccggatgcggccattaagggaatccgtgccatgaaccgtcctaccatattgatcggcggcggttatgataaacagaatgaatacgatgagtgggtggaggcttttgacggaaaagtcaagcttctcgtactcataggacagacaaaggaaaaaatagcggaatgtgccagaaaacatggtcttaccaacattgttttcgcagatacattcgaagaatgtatggaaatctgcgtgaaaaacgcggtatccggagacgcagtgctgctttctcctgcctgtgccagctgggggatgttccccaattatgaggtgaggggaaatatgttcaaggaatatgtgaataatctgtaactgtgaaggtacggaacagttacaataatctgaaggagtgattgcgtggcatccagaaaaaacagaaagcagtctgaatatttttttgattataccctgttatttatcgtgctgttcctgttaggcttcgggctgatcatggtgtattccaccagctcatatgaagcgtcgatatcggccaatctgaagtatgatgaggcttattatctgaagcatcaggcgtttgcggcggttatgggtttttttgccatgattgttgtggcgaatatcccttatcatttttgggagaggtttgcgacactgggatattttgtgtcggcgatattgatcgtgctggttctcacacctctgggtattgaggcaaacggcgccagaagatggctgaacctggggctttccgtgcagcctgcggaaatagccaagctctgtatgatcctgttcctggcaagctttatctgtaaaatggggaaagggatccggacgggaagaggcttctggatggtgctgatgatcccggtgccgatttgtgtgatggtttggaaaattaccaacaatatgagctccgccatcatcattttcggcattgccctcctcatgctgtttgtggcaagtccggattacaagcgtttcgtcctcatgggagcggcgggggttgccgcggttgccgcccttgttttcgccattatccagatggagcacagtgacctgggattccgcggcggccgtatccttgcctggctgaatccggaggattatgcttcgggaacaggcttccagaccctgcaggcattatacgccataggctccgggggaatattcggaaaggggctgggacagagtatgcagaagctgggcttccttccggaggcgcagaatgatatgattttttccattatctgcgaggagctgggattgtttggagggattgcggtcattctcctttttgtcctcctgatatggcgtttcatggtaatagccaataattcctcggatttattcggggcgctgctcgttgtgggcgttatgggccatattgccatacaggtaatcctgaatattgccgttgtaaccaatacgatacccaatacagggatatcgctgccctttatcagctacggaggctcctcggtcatgttcctgatggtagaaatcggacttgtcctgagtgtggcgaagggaattaagctgaagaacatataggcccgtcagggaagaaatttgcctgtacaaggtgtcaagatgccttctcccgcataggatagaatagttctattctgaataaaatccgggaaggtggaccattgaagtctatttatatcagcggaaacgcgcctttgtacggcgaagctacgatccagggatcgaaaaatgcagcgctgccgattatggcagcggctcttttaatccctggaatcagtgtacttaagaattgtccccacatagccgatgtggaatttatgtgtcgtatcctggaaaccatcggatgtattgtggtgtgggacaaaaacgaagtacgcatagatgcgtcggctgtaaaaacaagccggctgccggaagaatatgtgaccacgatgcgttcctccgtaatgctgatgggtcctatgctgggaagaatcggtgaagtgtctttgcattatccgggcggctgcgtcattggagacaggccgattgatattcatctgaaggcactggaacgtctgggagtctgttacagcgacagcgagcaggagcttgaagcccaggcggtccgtctgaacggcaccgatatttcactggagtttcccagtgtgggagccacggagaaccttatcatggcggcgacggctgcagaagggataacctgcatacatggaagcgcgctggagcctgaaataatcagcctgtgtgcgttcctgagagctgcgggagctgatatacgcggagaggagaccggctgcataacggtggtgggaggcaggaagcttcatccctgctgctttaccgtaccgtccgacaggattgtggcagggacttatatgtgtgcatgccttgctgccggaggtgaaatcttcctgaggaatgtgccgcggggacagcttacagccatggaagatgtggccatacgaatgggctgtaatctccgaagaggccaggacggcatgctcatacggcggtgcggagtccttttttcacccggctgtgtggaaacccgaagctatccgggattcccgacggatctgcagtcaccccttctggtcgccctttctctggcggaagggaaaagtgccctgcgggagacgatatttaacggcaggttcggcgtggtggatgaactgaataaaatgggaaccggcatccttgtgaagggggatgtggcctgtgtacccggcggccggagactgtcaggctgccatgtgaccgccagtgaactgcgcggcggagccgcccttgtggtggcgggcctgtgtgcggacggaatgacagaagtggcaaaccgctattttattgacaggggctatgaagacatttgccgggacctgtcgcagttgggagcggatatagacagttggtaggataggggctgtaaatgaaaacggataataaaaagaaaaacaagaaaaaaagtgtccggaatgagaaagccggcggcaggaaaccttctgccgcctctgccagcggctccgggaaaaaaagtgctgcaaaaccggcggcttcccctccgaaaaaaaatacggtcccggacagaagcaggagtatcggccgtgtggccgccactacttccaccggaaacaagcttcgtctggtaacggggaatgcgggcacggcgaagaacagccgttcatcgccgtatacgggcagcctgggcaccctgcagaatgaagggggcagaaagaggctgattgtcctgggcatcgcggcggccctgctgctgacagccgcaggcgcgctgttgtacataagcagccattatcacgtgaaatacatatatgtggaaggcaatgtccattatacgaatgaggaaatcatagcgttagtcacttctgagaagctgggcgataattccctgtatctgtccctgaagtataaaaataagggaataaaaggaattcccttcatagaaaaaatggatgtaaaggttgtggccccggatacgataaggatagtggtatatgaaaaggctgtggccggttatgtggaatatctggacaagtatatgtattttgacaaagacggcactgttgtggaggcttccgataccaaaacggagggaatcccccaggtgacgggcatcaacttcaatcatgtcgtgctgtatgaacctcttccggtggaaaatcaggaggtgtttaaggaaatcctgtatatgacccagattttatccaaatatgagatcagcgcggacaagatttatttcgatgacgcgtatgaaatgacattgtattttggagatgtccgggcaaaactgggaaatgatgacaatgtggaagaaaaaattgccaggctgaagcagatactcccggcggcagaaggaaagaaaggagtattccgaatggaaaattatgccggaagcggctccaatgtgtcgtttgaacaggataaataagtagaagaaaatgaaaaaagatattgcgttctttgcaaaataattatatgataagaactgtgaagtttatatggatatctaaaggaggaacaacctttgctggaaattaagacaaatgacgctgagtctgccgctaaaatcattgttgttggtgttggcggtgcgggcaataatgctgttaatagaatgatcgatgaaaaaatcgatggtgttgattttgtaggagttaatacggacaagcaggcgcttcagctttgcaaggcgcccaagctgcttcagatcggagaaaagctgaccaagggactgggagccggcgccaagccggaaatcggtgcgaaggcggcggaagagagtacggatgagatcaccaatgcactgacgggttcggatatggtatttgtcacgtgcggaatgggaggcggtaccggaacgggcgcggcgcctgttatcgcgggaattgccaagaaaatgggaatccttaccgtaggtgttgttaccaagcctttccgttttgaggcaagaacacgtatgacgaatgctttgaatggtatcgagcgtctgaaggacagtgttgataccctgattgttatccccaatgacaagctccttgagatcgtggacagaaggacaaccatgccggaagcgcttaagaaggcggatgaagtccttcagcaggccgtacagggaattacggatctgatcaatgtaccggctgtcatcaaccttgactttgccgatgtacagaccgttatgaaggaaaaaggaattgcccatatcggtatcggccacggcaagggtgatgataaggcgagcgaagcagtcaagatggctgtggaaagcccgctgcttgaaacaactatcgcaggagccaccgatgttatcatcaatgtcagcggtgacatttccatgtatgatgcggatgacgcggcaagctacgtacagcagctcaccggagatgacgttaatatcatttttggtgccatgtacgatgattccacaccggatacctgccagattaccgttattgccaccggactggatgacaagccccagcaggcgcagaacaaattcggctcccagttcagcgtgaagccccagcagtcgcctgtgaagcctgtgcagcccggaatgggaacaaggccttacaccccggtttcccctgctcctgcagccggaaccaagccggttgcccccgctcccaactataccggaatacataagcccggcaatctgagaagcaacgtggaagagaagtcccttaagattcctgatttccttcagaagaaataattccatataaacgttaaaggacagaaatgttcttccgatgcataaagcagccggatccgaatttacggatccggctttttttgtgccctgagtgaagcaattctctgaatgaaccgccgccgggcggttctattttgtcgaaaattatagacggatacagaagacaatatgtgtcattccgacaaaaaatgcaggggacggccgctataattaacccatgtaagcagtcctattacatacaggaggtgagaggtgagatacgtcgtatatatagaccgcctgtttctgcttcagtttgtacaaagctgcatactcttgctgctgacaagggcttttctgcacagcacggctgcgctgaaacggatcgtttttgcatcggctgccggagctctgcttttttgtatgatcctgctgctgcctgatgcaggcagaaggatgaagattctgctgttcgcatgcagcagcctggtgacgctgggaatggccttccggatcagaaccctgcagcatttctgtaaagctgtgattctgtatcatggggcggcgtttcttctggcaggagccctcaatgccctttacggagcttttggaagagccccttttatggataccatacaggcatcggcctgtgcggcgacaataggagtcactgtactgtgcgtcctgagatgggaaaagataaagagggaagagatagtgataaccgtgatcctggaagaaggaagcgtgcaggtgacgctgaaagccctgatagacagcggcaacagcctgtatgatcccataagcgggaaaccggtatgcgttgtggaaagagaagcgctggaagggaaaatcccattggatattcccgagaagttcaggctcattccctatcactccatcggaaaaaagcatggcatgatgcaggcggtggaaattgagaaacttaaggtaaagaaagatggacaggagttgattgtcgagaaagcgcttcttggactgtacgaaaataaggtcacagcacatggcggttaccagatgatcctgcatcctgcattatttgaaaatcggaggaacggacatgatattaaaagtcgcaataccaggaaaaatgcagtttaagatgattcgcagggaacccagtttccttttgtcagggcagggggatatccattatatcggaggagcagaggtattgccgccgccgctggaatcggaaaaagaaaatgaaatcataagcgaccttgggacggaatatgaagatgaggcaaagaatattctgattgaacataatctcagactggtcgtttacatagcaaagaaattcgacaatacaggcgtgggtgtggaggatttgatttccataggtacgataggcctcataaagtccatcaacaccttcaaaccggacaaaaatatcaaactggccacctatgcctcgcgctgtattgaaaatgaaattctgatgtatcttcgccgcaacaacaaaacccgtcttgaagtctccattgacgagcctctgaatgtggactgggacggaaatgaactgcttctttctgatattctgggaacggacgaggacgtcatttaccgggatattgaaaacgaggtggaacggaagctccttttaaaagccattaacaaactgacagaccgggaaaagaccattattaacttaagatttggtctcaacaccccggacggacaggaaatgacacaaaaggaagtggctacgcttctggggatttcccagtcctatatttccaggctggagaaaaagattatgaagcgtctgaagcgggaaatggtcaaagaataaagtttccagattttgtatttttactttggtatatttgggtgaaattgtgagaattctctttagtagaaaatgagagcaggaggattcggcaatggcactgaacaaggtggaaatctgcggggtaaatacttcaaaacttacggtgcttactaatgaagaaaaaacgcagctttttgagcggataaaagaaggggacgaagaagccaggcagaaatatataaaaggcaatctgcgtctggtgctcagcgtaatcaaacgtttttccaatagtaatgaaaatgtggatgacctgtttcagataggctgcatcggcctgatcaaagcgatcgacaatttcgattccacgctgaatgtaaaattcagcacttatgcggttcctatgatcatcggggaaatcaggagatttttacgggacaataatgcgatccgtgtaagcagatcactgaaggatacggcctacaaggctatctatgcaaaagaaaacctgatgaagcagaaccagaaggagccaaccattgccgaggtggccacggaaataggaatttccaaggaagatgtggtttatgccctggatgcaattcagaatcccatgagtctgtatgagccggtatatacggacggcggggacacactctatgtaatggatcaaatcagtgataagaaaaacaaggaagaaacctgggtggagcatctgtccttaagcgaagcgatgaaaaagctgaatgaaagggaatttgaaatcatatctctgcgcttttttgaaggaaaaacacagatggaagtggcagagctcatcggtatttcccaggcacaggtatccaggctggagaagaatgcactgaaggtgatgaaaaattatctgaccgcataggagatgatttgggaaaggccgggcatggccatatttgaaaagagaataaaacagcaggaaaactcctgtttgagtataacggctgtatccggtaaaacgggtatggccgttttctattctggttaaagccccggggcagatatcaggacagaaccataggtcaggagatgccgggacgtaatttgcagcagataaacagtagcagaagaaaatgcggagcatatgctagtaataaaagggaaaacgcatcgtgcggcagggagacggatatgcttttttcagaactgaaatgtaaggaagtcataaatttaagagactgcagaaagctgggacacgtaaccgattttgaatttgaccagtgcaccggctgcatctgcaagctgatcgtcccgggcggagctaaatggaaatcatttttttcctgtgatacggaccatgtgatctgctacaaagatattaagcagataggcccggatctcattattgtggatttaccggactgaacatgtttgaaaatagttttctgtgaaatatgcgtcacgctctgtgaggaggagtcttcacagagagggggcgtacagacgatgtggccgaacattagttcctaagttgacataaaaacaaacctactttataattagtaaagatatggaattatatggagggcggaaatgaatctgttttcagctttcctttgtttgagagtgtgcgggaacacagatgggagccagatatgaaatgtccgttttgcggtcgagacaatacaagagtaatcgattccaggcctgctgatgaaaataattccatcagacggcgccgtgtatgtgatgaatgcggcaaacgttttaccacctatgaaaagatagagacgattccgttgattgtcataaaaaaggacaataacagggagacctatgatcggtccaaaatagaggccggagttttgcgtgcctgccataagaggccggtgagcgccaaccagatcacccgcctggtggacgaggtagagacggatgtatttaatatggaagaaaaggaaatccccagccaggttatcggagaactggtgatggacaggctgaagagcctggatgctgtggcctatgtccgttttgcttcggtatacagggaattcaaagacatcaatacctttatggacgagctgaaaaaggtgatgagtacgaaaaattaaagggatatgccgtccgatcggaaaacagccttccaaacagaacgcgcataaacagcacgctttgttctgaaggctgttttccggtgaaatttgattggaaaatgattttgcagaataactttttcttgcatttttgataattattgtatacaatactacggtaaaactaaatatagaataagtacttttcacgccaggtcgggaaagtgctgagagagaaaggaaaaacacatgaagacaaaagctttaaaacggtttcttttgactttagtgttcacaacactaactattgcactgagcgcatgctcaggtgataaggcaggtgagagctcttctcagataacgattggcatacctcaggatattgaagacagtcttgaccctcacaaagcagtggcggcaggaacggaagaggtactgtttaatctgtacgaaggacttgtgaaaccggacagcagcggagatctgcagccggcgctcgcgagtgattttcagatatcggaagatgcgaccacctatacctttaccttaagggaaggggtgaaattccatgatggcagtccggtaacggccggggacgtgaagtattccatagacagatgcgccgataccacgaatggggaccccctggtagcggcgtattcccatattcagagtgtgaatattctggatgaaaagacggtggaagtggtactggacggcccggatacggatttcctggcttatatgaccaatgccgttattccggcttccaatgagaatccggacacgaatcccatcggcaccggcccttacaaatatgtatcccgttcgccccaggaaaattttgtggtggaaaagtttgatgattattgggggacccccgccaatattgagcatgtaacttttaaggtatgtgccaatgcggattctatcgtcatggatctgcagggaggatccatcgatatgtttgccagggtgacaccggcccaggcggatcagctgggagacagcttccaggtgctggaagggacgatgaatctggtgcaggccttatatctgaataacgaggccgaaccttttaacaatgagcttgtgcgtcaggcgctgtgctatgcggtggatcctcaggaaatcatggatatcgtttccggagggaagggaacagaaattggaagcagtatgttccctgcttttgggaaatactatatgcctgaactgaacgacatgtataaacaggatctggacaaggcgaaggagcttctgaaggaagcgggatatgagaacggcttttcttttaccataaccgttccttccaattaccagcagcacattgatacggctcaggttattgtggagcagctgaaaaaaatcggcgtgacggcggaaatcaatctcattgaatgggacagctggctttccgatgtttatgcgggaagaaaatacgaggccacagtagtgggtgtagatgcgtccagtctgacgcccagcgccctgctttcccgttttgtttccaccgtaagcaacaattttgtcaatttcagcaatgcggattatgatgccgcctatgctaaagccctcggtaccattgatgacgaagaaaaaacagcggcctttaaggaatgtgaaactcttttggcggagcatgccgccaatgtatatatccaggatctgccttgtctggtggccctgaataaaaaatacgcagggtatgaattttacccgctgtatgtgcaggatatttccaagctctatattgtggaagattaacacaggattccggcttcgcaggggagagtgagtgcgacgtgaaatatatgattaaaaaactgatatccatggcggctacccttctggtggtgtcctttctggtgtttctggcctttgcggtgataccgggggaccctgccacttcgaagctgggcacggaggcaaccccggcaagggtggaagcgctgcgggaggaaatgggactgaaccgcccgcttcccgtgcggtatgcgagctggctggcagggatgttccggggagatctgggaacatcctacagctacagcatgcctgtaacggatatggtggcggaaaaaattcccgtcactctgactttgacattgatggcgtttgccatgatggttctgatttccataccgctggggctttatacggccaaacatgagggcgggacggcagatcatgtggtttccgtactgaaccagatcattatggcgattccgccttttttttcaggtatcctgataacccttctttttgggctcctccttcatctgtttacgccgggaggttatgtatcctatacgaaaagcatagccggtttcatcggctacctctttttccctgcactgtcaatcgcccttcccaaggcggccatggctgtgaagctgctgcgcagctccattattcaggaaatgagccaggattatgcgaggacggcatacagcagaggaaacagcacgagagatgtgatgtaccgccatcttctcaaaaacgccatgattccggtggtgactttcctgggaatggcgctgacggacatgattgcggggagcattattatcgagcaggttttcaatatcccggggctgggaagaatactgctcacctctatttcaaacagggattatccggtagtggaggctattattgtactgctggcctttcttgttattttcatcaatttcctggtggatttcatttataagaaaatcgatcccaggattcgtgtacagtaaccggaaagaagaggcttagctatgaagaaaaagaatctgaatttaattcttggaagcatccttacgggccttgtcctgcttgtggtgcttgtgggaatcttttatacaccgtatgacccgactgccatggataatgcgaataagctttccggcgtcacgctcgcccatcccttcggctgcgataatttcggcagggatattctgagccgggtgatgcaggggagcggcaccaccttgtcggtggctgtgtccacagtggctatcggtacctttttcggagtcctgctgggggctttcacaggctatttcggcggtctgctggatgaaatcctgatgcgtatcaatgatgtggtgttcgccttcccgagcatactactggcgctggtattcatcagcctgctcggtccgggaaagggaaatgtgatcatttccctgggaattgccttcattcccagctttgccaggattgtgcgttccgagttcatacgctgtaaaaatatggactatgtgaagctggcaagactggccggggccggacatctgcgcatcatgttcgtacacatcctgcctaatacgcttaaggtgcttgtcccggcggtgatgatcggtttcaacaatgcggttctggcggaggcgggcatgagctatctgggaatcggcgtgcagccgccggatgccagtctgggaaggatgctttccgaagcgcagacctatatcttctcagctcctggttttgcattgtttcccggtgtattcatcgtcctgatggtgcttggcttcagcctgctcgcggaggggctgaaaagggattaaggaacagggagctgctccttgggaaaggctggtaacgttatgcttgatgtcatagatctgaatctggagttccatgaccatctggtcccggaaacagtggtttatcattttaaccttcatatggaggaaggggatattatcggtctcgtgggggaatccggatccggaaaatccatgaccgccctggctattgcagggcttctgcgcagacatgatatgaaaaaaacaggacagattctgttccggggaacagatttgctcacctgtcccagaaatcagctccgcgcttttcagggagatgatatcgggattgtgttccaggagcccatgacctccctgaatccggtgtaccgcatcggctggcaggtggaggaaagcctgcgcatccaccgtccggaaatgagccgtgatatgcgcagggataaggcgatggagatgctgaaagcagtggagctttcggagccggaacggatttacaattcctatccgcatcagatatcaggaggccagcggcagcgcgtgatgatagccgccgccatgatctgtgatcccaggcttctgatagcggacgagccgaccacggccctggatgttaccgtgcagcttcagattgtcaagctgctgtccaggctcaaccgggaaaagaaaacgggtatcctctttatttctcatgacttgagccttgtaaaacgtctctgtgagcggattgtggtgatgaaggacggcgctgttgtggaggaaggggactgtcaggaaatttttgaacatccaaaagagccctatacccgtaacctgatagccgctattcccagatgcgtgaagcctgcggaggtttgagatggaagaaaaacagacaaattatgttcttatggtaaaggatctgcgggtttcctatgcacaggaggaaggaggcctgttccatcccaaaaaggatctggatgtcctgaagggagtatccttttccatcagggaaggagaggtcctggggctggtgggcgaaagcggctgcggaaaatccacgctttccaaggcgctgctgggtctgattcccaaatacgagggagtgattgtccagaaatccctgcatccccagatgattttccaggatccctacagctcgctgaatcccgtgaaaaaagtgggctggattctggaagagcccctgcggttgaatacggagctgaacaaacagcagcgcagggaaaaggtcctggaaatgctgaaaaaagtgggcctggatgaaaagcaggcggatcgctaccccagacagctttccggaggccagcggcagagagtgtgtatcgcggaaagcctgatgctctcccccaggcttttgatagccgacgaaccggtatcggcgctggacgtgacaatccaggcacaggttatatccctgctccgcagcattcagaaggaaatgggccttgccattcttttcatttcccatgatatgcgtgtcgtataccagctgagccagcgggtcatgatcatgaaggacggagaaattgtggaaagcggggatgtggatgatgtatatttccatccggagcacccctatacaaaaagactgctggaggccgcggggatcgaatcccccggagaagagcctgcccggcccgtttcctgattcgtctgcaatagtacttatttaagagaggtatgaaatacatgtttgagaagttttatccggacagttacgtggaaagcgcttatgtaatagattatgaggggctgtataaaaagggatacagggggattatttttgatattgacaataccctcgtgcctcacggcgctcctgcagatgagaggagtattgcccttttccggcggctgaaggccattggctatgaatgccttctgctgtccaataataaggaaccccgggtaaaaatgttcaatgacgccgtgcatgtacattatattttcaaggcgggcaagcccggtgtgaaaaattacgaaaaagccatggatatcatgggtacggatgatgtcaatactttttttgtcggcgaccagctgttcaccgatgtctggggagccagaaatgccgggctgtacagcttcctggtgaagcccattaacccgaaggaagagatccagatagtactgaaacggtacctggagaaaatagttctccattcttataagaagaaactggccgcagggggaggaaaataatatgattgacggtaaaaccaaaacctgtgcactgctgggaaatccagtggaacacaccctttcccccatcatccacaacaccctggcacagcgctgccaaatcaacatggtttatgtccctttcctggtagagggcagccagctgcgccaggcagtcgaaggcgcccgggcgctgaatatgctcggcctgaatgttacggtgccccataagagtgcgatatgccccttcctttcagaaatcgataaggaagcatcctatatcggagccgtgaatacactggtcagtacaccggaaggcttcaagggctataacaccgatttaaccggactccaccgggcccttttatcggaagggatccagctgtccggagaagaaataatcctgctgggagcaggcggcgcagcgcgtgccgcggctttcctctgcgccctgcgcggagccagccaggtataccttctcaaccgcagcctggaaaaggcagaagcagtagcccgggaggtaaaccaaaaagcggaacgagactgcatacgagccatggatctggacggctggaagcagctccccgcaaaaaagtacctggtaatccagggaacctccgtaggccttgccccccgcaccgaagaagcagtaatagaagacaaagctttctacgaactggtacatacaggctatgacctggtataccgccccgcggaaacaaagtttatgaggctggtcaatgaagcaggaggaaaagccttcaacggcctgaagatgctcctctaccagggagtagaagcctttgaactatggaacaacaccaaagtacgggaagaagatgcgtatttttgctatgaacagatgaaaaaggaactggaagaacatgagggacagaaataacaacatcatcctgacaggatttatgggaagcggcaaaaccacagcaggcatccgcctctcctaccgcctgcgcctgccgctcctggataccgataaatggattgaaaaagaagaaggcagaaccatctccgaaatctttgccctccagggagaagagaccttcagaaaaatggaaacatcggccctgagaacccttctcgaattggaaggagaacagatcatctccaccggaggcggacttcccatgcgggaagaaaacagagaactgctgaaaaaactgggaacagtagtattccttcgcataaaacccgaaactgtatacgacagactcaaaggagacaacacacgcccccttctgaaaaaagcggaccccatgaaagaaatccgccgtctcctggaactcagaaaccccgtttaccaggaatgcgccgacatcaccgtcgatgtggacggaaaagatttcgaagaaatcatcagcgaaatcatagaccgaaccggaaaaaacaaggagacagaccatgaaaatactagtcattaacggccccaacttaaactttttaggaatccgcgaaaaaaacatctacggaacccaggactacaactacctcctgaagctgctccaggaaaaaggcgaacaaaccgacacccagataaccgtattccaaagcaaccacgaaggcgccattatcgaccgcctccaggaagcctactttgacggcacccagggaatcgtaatcaaccccggagcctacacccactacagctacgccatccgcgacgccctctccagcatcaccgtccccaaagtagaaatccacatatccgacatcaccaaccgcgaagaattccgcaaaacctccgtcaccgcccccgcctgccacaaacaaatctacggccagggcctcgacggctacctccaggccatagattatatcctctctacttaaaacaatcccaattccgcccttatttccctcatgcattcttttggcttgccaagactgcgtttttccccggcccgaaggccccctggatgcgcggcggtcccggccatgcagagattcctgtaaggggcgtcataaactcgccggtccttaggctgtgtcctttacagccttagtaccgctgcgtgtttatccgagcgaaagcgtcccctgcaaggaactctgcatggccgggaccgccgcgcatccagggggccttcgggccggggaaaaacgcagtccctcccggtgaaaacacttcttgacagcagctaaacacggaatttgcccagcatattattcaaaaaagcaaattctgtaaaaaaagagttgaaaaaagagaaattttattataaactagtaaggaattaaacgcgaaaatttaggaggaagattttttatgatttctgcaggtgatttcagaaatggtattacgattgaagtagatagcaatatttttcagataattgaatttcagcatgtgaaacccggtaaaggcgctgcttttgtcagaaccaagctgaagaatattattaacggaggcgttgtcgagaaaaccttccgtcctactgaaaaattcccgcaggcacgtattgatagaaaagatatgcagtatttatattccgacggtgatttatttacttttatggatatggaaacctatgatcaggtggctttgaatgccgagactgttggtgataccttaaagttcgtaaaggaaaatgagatctgcaaggtatgctctcataacggcagtgtttttgctgtggagcctccgctgtttgtagaactggagattaccgatacagagcccgggttcaagggagataccgctacaggtgcatccaaacccgctactgttgaaaccggagctgttgtatatgtgcctctgtttgtgaaccagggtgacaagattaagatcgacaccaggactggcgattacctttccagagcataataaagacaggcatcattctattattagcctataagacaatgagatttctgcgtggcagagctttcattgtcttttttttgacaattcgaagagaaagcgaagagggaagactgctgccatatttcaaaaaaagagaggaaatggaatggaattcgaaaagtttctggaaaaagtgaaaaacgccgtacaggcttattttggtgaaaatctccgcctgacggtgagcaatgtgctcaaaaataacggagtgactttaagcggtctgatttttatgtgtgaggacagcgaagtggcctccaccatttatctgaacggtttttatgaggaatacagccagggacagccctttggcgaaatagtccgccggatatgcgccgtatatgaagaaaataagccggatcaggatctgaatatggacttttttaatgattacgccaaagtgaggcccaagttggcctgcaggctgattcattatgagaaaaacaggcagcttctggaaaagcttccccaccgcagatttcttgatatggctgtagtatactgctgtatcatgatgagcgaccgtataggctgtgcctgcgtcctgatcaacgacagccatatggaattatggcaggcatcggaggaacagctctatcaggatactatggataatatgccccgtgtgctgcctgtggagttctcctccatggatgattttatgttcgatgtcatccggaaagcgatacaggataaaatggaggaacccccggaggaagacagtgaaggctgccaggccatgcttgatgaggttgcggaaattcttgtcggatggccgaagaaggaaaatccggagagaaagatgtatattctgacaaataaacagcgtttttatggcgcggcgtcgattctgtatccgggagtgctgaaaaaatatgcagacagctttggctgtgatttctttatttttccaagctccgtacatgaagtgattcttttgaccgatacaggaatagaggacagagaacatctgtacgacatggttcatgaggtgaactgtcagaacgtgccgcaggaggagctcttatcagatagtgtctattatttcagccgtgaaagcggccggataacaattctttgaaattctgtctaattcttaaaatgatctaaaaaatctatttttccaaaatgtggtctggacatccggggaaagttatgctaatatatgtcagagtgatgcatgtaacaagtttgtaataattaatcaatgcgtcatcatatagcttatgcacccgtagtctaatggatagaacggaggcctccgacgcctttaatgcaggttcgattcctgtcgggtgcatttgtgtcactctggcatatgtttcctccggaaagatatgccaaacttttgacggatgtaaatttacggctatagtattaagaatgaaggtgtgatattgagcgaagaacttaaagataagaaggacggatccaattcggagggatcccctaatgaatttgtggagctgttaaagaagaataagaaatcgctggcagttatcgtggtaattgccgttgtgcttttgggaatcggcattttgctcggctccctgataggaagcaggtcaggtaaaaataacaacctgcaggcaggagcccagtcttcggagcctgcggaaacacagacagagaccgcggtgcccgatgtgccgctggaagaaaatgcagatccggaagtgaatgccctgatggaaaaatattatcaggcggcagccacaggggatatcgaaaccattaattccctgaaggattattcagaccaggccgaactgctccgcattcaggaaaagagcaagtacctggaaagctatgatgatattaactgctataccaaaccggggccggaagcggattcctatgtggtttatgttacttattacgccaagttccatgatatagagcagaaggttaccggtcttaatacttatatcgtatgcaagaaggatgacggaagctattatattcatgactgttccgaggatgaatccatgaaggaataccggacgaacgtcaccaaacaggatgatgttgtggatctgttcaaccgggttcaggtagaatataatgaggccgtcacggaaaatgaagagctggccgcattccttactgaattatcggagaatctgaaaaccgcagtgggagatgccctggcggaagcggaaacagcggcacaggaaactgaggaagagagcaatacggaagaacctgtcagcgcaggggaagaacaggcggcaggccgggtgaaggccacggatgtggtaaatatccgcaaatcagacagcgagacggcggacagcctcggcaaggcccaggttggagaagaatttgcactcatggagaaccgggcgaacggctggtccaaaattgaatatgacggacaggaagcttttattaaatctgaatttttagaggcagtgaatgatgcccctgctgatgatgaacagggcggagacgatcaggctgctgataatgccggggaaccggaaaatacggacaacggcaatgatacaaatacggattccaatcatgctgcgccgggtgccggtgacggagcggcttctgtagaagtgccgagcagcggaacctaccgtctcaccactaccgtgaatatccggaaatcagccagtgaaacagccgacaggcttggtgtgggttattacggggatgaagtggaaatcctgatgaaacaggctgacggctggacaaaggttaaatttaagggtgaaaccggttatattaagaccgatatattgaaataacgacaggaaagcattgtgagaatctgtttacagcttttggaataaggaattcatataccgggaatactttgtattatcaaagtattcccggtttttttatactttattttaccggcaggatgaagggaggcagaaagatgcgcggcgatgatgcggcgatatacagagaaattcagaaaaatgcggagatgggaattaaggcaatagagaccttgactccgaagctgtcagatgatgcctttgctctgcagctgagcaggcaggaactgaagtattcggagctcagggataaggcgaggcaggagatgctggaaggaagaggggaaacctatcaggcaaacggggtatcggatctgatgctgaaaggcagcatacaggccaatacacttctcaataccagtacaagccatatagcggagattatgataaaggaagaaaacagaggcttgacaagcatgtggaaggccctgaaccattttgggaatgcgggaaatgcgagtacggaactggcccgggaactcatggattttgaggaagagagcattgaaaaactgaaaaagtatttataatctggtgtttttcagcaaatttcgtcaagttaacgtaataaagtacttgcgtgcaggctttatccattatataataatagccggacaacggcgtctgaaaaactcaggtcagaagtctgctctgggttttttcaggttaaaacaattaaggaggaattacatatgtcatatgtagatgaggtcattgcgcaggtagttgagaagaacccggctcagccggaattccatcaggctgttaaggaagttctggaatccctcagagtggtagtggaagccaacgaggaagcttacagaaaagatgcgttattggaaagactggttaatccggaaagacagattatgttccgtgttccctgggttgatgataaggggcaggtacatgtaaatacaggtttccgtgttcagttcaacagtgctatcggcccttataagggaggcctccgtctgcatccttctgttaacctgggcattattaaattccttggatttgaacaggtatttaaaaattctcttaccggacttcctatcggcggcggtaaaggcggttccgattttgacccgaagggaaaatctgacagagagatcatggcattctgccagagctttatgacagagctttacagacatatcggagcggataccgatgttcctgccggggatattggaaccggagcaagagaaatcggatatatgtatggccagtataagagaatccgcaacgtatacgaaggcgttcttaccggaaagggcctgacctacggcggatccctggcgagaacggaagcaacgggctatggtctgttatacatgacaaaagaaatgcttaaatgcaacggcatcgatatcgcaggcaagaccatcgcagtttccggttccggaaatgtggcaatttatgctatccagaaggctcaggagatgggcgcaaaggtagtaacctgttctgattccaccggctgggtatatgatccggaaggaattgatcttgcggcgctgaaagaaatcaaggaagtaaaacgcggaagagtatccgattatctgaattacagacccaatgcggaatatcattccggcaaaggcgtatggagcgttaaggtggaaatcgcccttccctgcgcgacccagaatgagcttgccctttccgatgcggaaggccttgttgcaaatggggtgaaggcagtatgtgaaggcgctaatatgcccaccactctggaagctaccgagtatctgcagaagaacggtgtcctgttcgttcccggaaaagctgcaaatgccggcggtgttgccacctccgcgctggaaatgagccagaacagcgaacgtctcagctggagcttcgaagaagtggacagcaagctgcagggcatcatgattaatattttccataatcttgatgatgccgcaaaacgttatggtatggaaggcaattatgtggcaggcgccaatattgcaggatttgaaaaggttgcgaccgctatgaccgcacagggaatcgtgtaagtcactttattgctgaatagggataaaggcaaaaatgccgcaggttaagtcatttggcttagcctcggcatttttctgtttataacctattgtaaggggcatccgggaaaaggcggcatgaaagaaacggataagggaaggagccggagaatgacggactgctaaccataatcttcatcagcagtccggaagaaatctttgagctccgcgtggaaaacctctttcatggccagaagctcctgcacactgatattctgaatacctgcttctatttttgcataggatccccttgtaaggctgcagcctaaaagctgcagctttgctattgtctgttcctgcgtaaggccgcaggaattgcggagagtgcgtatattggcacccagagaaacatcgtgttttactttctgcataaaaactactccctagtgtttagttcagcctccgccgccatttcctgcccgcctttttaaatactccttaaggctgtgtcagccatagcttccgattccataaggacactgcaaagtgacctgcctcatgtatgagacttatgcaagactcaccatattattcatttacttcaaataaaataattattcggcaaatggttcccaagagactcggatggcgggtagaaaatggagacggaggctgaactagaagctcccgatctcattattggtatatattattgattttattaaaaaagtaggatataattgctctataattagagcaaaaagaagatgtgcccgggaaaggtgttggaatgattgaaaaggaattatgtgctttaacaaaacaactgatgcttacctgtatgggcggtcgtaatcttgataaaatacaggaaattaccgggtttttcacaaataatgccgtggtgatcggaagccactctgacgaattctacacatctgtagaacaaatagaaaatgcactgaataatgataaatggaaagagggccggaactatatctgcaggcctgtgaaagaatggttccaatgcattccattgtctgaaaaagtctttctggtatgcgggaatatcaggcttgaaatgatttttggctcaggggatgcaggtgaggccgcacaggactacagagccgggctgtcggaggctgatgtcagagtcagcgtggtatggaagctggaaaaggaacagattcatgccttacatatccatttttccctgccggaggaggatttcctgccatgcagggcggaagacctgacaggcacagccgctgatgaatatcatggcagtgcggaccgcaaggaggcagcttattacaagaaactttcggaacgggatttgatgaccggcctgtacaacagaggaagttttgaaaaatatgtgaagctgcagcttaatgaagtcggcggcggcactttttatatgattgatctggatgatttcaaggcggttaatgatacctatggacatgtggccggggatcgggtgattgcaggtatggcaggaatcctcagagaggtattcggggaatcggccgtcatagggaggttaggcggtgatgaattcgccgtttttgaaaatggcagcagttcaagaaaagaatcggaggaaaaggccaggagggtcatgcaggcatatcggctcatgtcggaaaaatacgggaatgaaatcctgctgagctgttccatcggcctttaccgggaaaaaggaaaggaaaccttcgaaaatttatattcctgtgcggatgaagcactttacttttcaaaaaacagttataaagggacttttcactggtattaccgtcagtgcagaacataacaggtctgctgctgacggttctttatttctggaaagatttatggtaatataagttaatgctgtgcaaagcagaactttaacggccattttgattggaggtattatgaaaaagaaaaagacggacagtgctgtaattatctacatctgcctggccgcattgcttattcttgctatccggtattttgatgatattgcaggaatggcagtcaatttgtggaatgtattcttttcgcttgtccttggagcggcggtggcgtatgtgctcaatattatcatggtgcgtgtggagcggttttattttccgggttcccgtaataaatggattaattccagcagaagaggcgtgagcatccttctttccattctgcttgtgatgggaattatcgcgctgattggaggactggtccttcctgagctgggaaaagcgttcggagtgatcggccggaatgttccggtctttttggaggaggccgccggatggcttgagaaaaacaatgccatgaacatcgcggcaggtatcaaggacgtggactggaacagcatgatggacagggctgtggactttgcaaaatcgggccttggagatgtgcttaattctacaataaccgcggtgggcgctgtggttggcagtgttgtgaatttttttatcgggctggtatttgccatttatatcctttccggcaaagaaaagctgcgttcgcaggcggggagaatcctgcgtgcctatgtaaaagaagatacgattataaggttaaggaatatttacaggactgcggatgagactttttccagttttattatcggacagtgtacggaggccgtaattctgggtacactctgtactgtagggatgctgctgctgcgtttcccctatgcgcccatgataggcgcgtttatcggggcgacagctctgattcccattgtaggagcttatctgggagccgctgtcggggcatttatgattctcacggtggatcctctgaaggcgctgctgtttattatttttattgtagttctccagcagctggaaggcaatctgatttatcccaaggtagtgggttcttccatcggccttccgggaatttgggtgcttgcggctgttacggtgggcggcggactgggggggataggaggaatgctccttggagtccctgttgcggcgaccgtatataagcttatccgcaatgatgtaaacaggagaaatcaaagcgaaaaaaagattccggttgagggggcagcatctgcaaggcagaacggaaagcagaaaggaagatagcagatgaaagggaaatacaaaagactggtggtcaaccgtattgtggttacggttgcgcttattttgcttcagatcctctggattgtttttatgctggaggagcttgcgaaatattccagttggataacaacagcttttacggtactcagtattgttattgttttgtatattataggaaaagatgataattcggcttataaaatcggctggattgtattaattatggtactgcctttgttcggcggcttgctttatctgttctcgggtgataaaaagccttcccgtgggatgcgcagaaagctgaatgagcagcatgaactgtttaaggaaagcctgcttcaggaagctgaaatacaggatcgcctgggcaaggttcacggacgtgcggcggggacctttgattatgtgaggcgggtgggtgattttcccgtctacggaaataccgatgttacctattatcccagcggggaagaaatgtttgtggatatgctggatgagttaagggctgccaaacattttatctttgtggagtattttatcgtttccgaaggggaaatgtgggaagaggttctgaaaattctgaagcagaaggcggatgaaggcctggatgtccggatgatatacgatgatatgggttgcgtgaccctgcttccgggcggctatttcaaatggctggagaaatgcgggattaaatgtatggccttcaatccggtgattccgttcttttccctggtcatgaataacagagatcacaggaaaatccttgatattgacgggcataccgcatttaccggagggatcaacctggccgatgaatatattaacaaaaaggtgcgtttcggttactggaaggataccggggtaaggctgaaaggcgaaggcgtatggaactttacggagatgtttctggaaatgtggaatgctttccggaaagaggatacggatatcagctgcttcaagccccatgtgtaccatccggaaccctttgagggagaaggctttgtacagccttataccgattctcctctggataatgaaacaattgcagaaaatgtgtatctggatatcctgaatcaggcgaagaaatatgtctacatatttacgccgtatcttattgtggatgacgtgatgcgcaatgccttgtgcatggctgccaagaggggagtggatgtgagaattgtcacaccgggaacaccggacaagcccacgatcttccgtctcacccgttctaattatcctccgcttttaagagcagggatccggatatatgagtatactcccggctttatccatgcaaaaagctatatcagtgatgatgaattcggtgtcgtgggcagtgtgaatatggatttcagaagcctgtaccttcattttgaatgtgcgaccctcttataccggacaagcgggctgaaggaactgaagaaagacagcctggatacgattgaggtgagcagggagattacgctgaaggactgcaagcagggcattataggcggcctgtttgattccgtgctccgtgtattcgctccattatgctgaggaaccataaagtgtaccgggaaaagaacagggcggcgttgacaagggaaaaaattaaatttataataggatagattagcgattttggaggaaagaaacgtgaataaatacggagtaaatgaactgaggaagatgttcctggacttttttgaaagcaagggccatctggtgatgaaaagcttctctctggtgccccataatgacaacagcctgctgttgatcaattccggtatggcgcctctgaagccttattttacagggcaggaaatccctcccaggaagagagtgaccacctgccagaaatgtatccgtaccggtgatattgagaatatcggaaagacggacaggcatggaactttttttgagatgctgggcaacttttcctttggtgattatttcaagcatgaggctattgcctggtgctgggaatttttgaccgaagtggtcggactggatccggacaggctttatccttccgtatatctggatgatgatgaggcctttgatatctggaataaggaaattggtatccctgcggagcgtattttccacttcggcaaggaggataacttctgggagcatggttccggtccctgcggcccctgttccgaagtctattatgacagaggggaaaaatacggctgcggaaagccgggctgtacggtcggctgcgaatgtgatcgttatattgaagtatggaataacgtattcacccagtttgacaatgacgggcacggcaattataccgagctggatcagaagaacatagataccggcatggggctggaacgtctggcggccgtggtgcaggatgtggattccatttttgatgtggataccatccaggcgctgcggaacagagtatgcgagcttgccggaaagacatataaggaaaaccatgactgggatgtttccatccgtattgtgacggatcatatccgttccgccacctttatgatttcggacggcatcatgccttccaatgaaggcaggggctatgtcctgcgccgtatcatccgccgcgcggcacgtcacggaaggcttctcggaattaaaggggatttcctggcaaacctgagccataccgtgatcgagggaagcaaggacggctatccggagctggaggagaaaaaagactttattttcaatgtgctgacacaggaagaaagtaaatttaataaaaccattgaccagggcctgagtattctttccgatatggaagatactatgatgaaggaagggaagactcagctgtcaggcgaggatgccttccgcctttacgatacctatggttttcctttggatctcacgaaggaaattctggaggagaaaacccttaccatcgatgaagacggtttccaggctgccatgaaggagcagaaggaaaaagcccgtgctgccagaaaggttaccaactatatgggcgcggatgttacggtttatgaatccctggatccggcaatcagttcggaattcgtaggctatgataagctggtatgggaatcggaggtcacagccatgacaacggaagaagccgtggttgacgcccttacggacggagaaaacggaaccattattgtttcccggactcctttttacggaaccatgggcggacagtgcggcgataccggcgtgatccgctgtgccgacggtgaatttgaagtaaaggatacggttcatctggccggaggcaagataggccatatcggcaggatgaccaaaggaatgattaaaaacggggacaaggtggaacttgccgtaaacgcgtcggaaagagcggctacctgtaagaaccacagtgcaacccatctgcttcagaaggctctgcgtacggtgcttggttcccatgtggaacaggcaggctcctatgtggacgcaggcaggcttcgttttgatttcagtcatttttccgcaatgacccaggaagagctggataaggtggaaaagattgtcaatgaggaaatcgcagcccatcttcccgtacagacctctgtcatgactcttgacgaggcgaagaaaacaggcgccatggctctgtttggggaaaaatacggcgacagcgtacgtgtggttcagatgggggatttctccacagaactctgcggcggtacccatgtggccaataccggtgacattgccgtgttcaagatactgtctgaaaacggtgttgcggcaggcgtgagaaggattgaagccataacgggaacgggtgtttttgcttattataaagaagtggaagaaaagttagccgaagcggccagaattgtaaaagcaactcccgcaaaccttgcagagaagcttacccacctcatggcagaagtaaaacagctttccagtgagaatgaatccctgaagagcaaggcagccagggaatcactgggcaatgtaatggatcaggtaaaagaggtcaggggtgtcaggctgttggcagccaaagcggataacgtggatatgaacggactccgtgagctgggcgaccagctgaaggaaaagctgggagagggcgtagtcgtactcgcttctgaaaaggacggcaaagtaaacctggtggcgatggcaacggaagaagccatggcaaagggagcccatgcgggaaatctgattaagggaattgccgctcttgtaggtggaggcggcggaggccgtcccaatatggctcaggctggcggaaagaatccggcgggaatacctcaggcgattgtcgaagtcgaaaaagttctggacggacaaataaagtaactggtaacggcacggaaataggaaaaatgaacaaaaattgatgaaaattaacgttttgactcactttttcataaaatatacttaatttattaaaaaagtagttgacgtcctttcaatttttggtataatatttcttgtgcattggtatgcataaaaaacccaatcagtcgtgaacttgaagggactgaagggaggtcaggtgtgagctatgtctaacattatcgtaaaagaaaatgagactttggacagcgcattacgtcgttttaaaagaagctgcgcaaaagctggaatacagcaggaaatccgtaagagagagcattacgagaagcccagcgtaagacgtaagaaaaaatccgaagcggctagaaaacgtaaatataactaagaaaacggaagtccttggcatttattaccaaggacttgtgttttatacggtagagaatgcgccggtccggcagtggaaagacagccgggcgggaggctttctatgaggatgataagtccggattatcagaagggaaagacaatatgtggataaatggaatactgggagctgatgtttggcatctggtcgcggcgttctgtatttacagtgttctgggctggcttgtggaatcgatctatatgtcaatctgtaaccacagactgactaacagaggatttgccaaaggtccgttctgtcctatttatgggttcggagcacttgtcggttattttttgctgcgtccttttgccgggaatccggtgctgctgtatttgacaggagcttttattgccacggtatttgaatacctggtcggaagagccatgctgcgtatattcggagaggtatggtgggattacagggagaagccctttaattatcagggcattgtctgcctggaaagtacgattgcctggggattttatgcggtcattattattggatatctgcataaggccgtaatgaatatggctacatggtatacatatggaccggggctttgggtgctcaggattattattatattatttacgattgactttttacatcagtttctgtctgcgcttcattttaatgtgatggagcagagagacaggctgatggaaaaatacgaggaatttaaggccagatggtattaactctgacgtataaggcggggaccttcaggcccctgcctttctattgttcagaattggcaggaatttccgggaatatggaacaaatggacattggtacagaagagcaggaggaaggttacagatgaactggaagaaaagaattgtcagcctcgtattggcggctgtcattggtgttggaacatttttatcttcgggtgtggaagcggaagcagccggagtgataggcaaggggatcgatgtatccaaataccagggggctatcaactggagcgcagtggcggcagatggctacagctttgcgtttatcaaggtgggaagcgccaaaagcggcctggatccttattttgcggcgaacatggtgggcgctaatgccgccgggctgaaaacaggcgtttatctttattcctatgcgacaacggtagaagcggccatggcggaggcccagttcacgctggcggccatcgcaccctttacggtgaatatgccggttgtatttgacctggaggatgcggtacataaatctatgacgccggaacagctggctgcgcttaccgtagttttctgtaccattatccagagtgcgggttattaccccatggtgtattccagcaaaaactggctgacacagcgtatcgggcctgttcccttcgatgtttgggctgcccagtatgcggatgcctgtgaatatccgaatccggccttctggcagtttaccagcagcggtacggtaaacggcattcagggaagggttgatttgaacttccagtttaaggattattctaatatcattatcccttatggttttaccacaaggggaggcaagacctatttctataacaattaccgtatgcagtacggctgggttgattatgaaggcaaccgttatttcatgaatgcggacggtaccctttataataatggctggctgacagacggtgtgaatacgttctatatggatacgaaggacggccatatgctccgtgatttggtgacgatccagggcaagaattattatttcgatgtcaacggcttcatgcagaagggttatgttaccattgcgggcctcacctacctgttcggtgcggacggttccatgcagtatggctggtttactgatgaaaagggtgttcgttacttccaggaagacggcagcatggctatgaacaaaacgctggtacttgacggaaagacttatgtgtttgatgcttccggctatggacaggaagtggttgctccggatattgatctgaccggtgtggatccttccacatgggtgctggatccggcaacaggcaatatgattgacactgctacaggacttcctgtggatccggcgattgcggctgctgtaatcgcgcaggcacaggcggcagcggcgcagtaaagcggcggcgcggcagcccgagaaaagcagctgttccgatttgccggctattaagccattaataatacggactgtccggaaggcgatcatgccctccggcggtccgttttttgtgtcggaagcccgatttgtgcagggacatgcccaaaatctgccgaagaccggaaattaaagcacactccaggaataatccccacgcacgtacataaaatgtgttatagaacttatgtggaggggagtttcccttatgaattgtgtgaaacaaaaggcaatagcgaaaaagcttatttccttcatgctggtcatatgtctgataggaatgccggaaataaaaggatatgcccaggaaggggccccggtgtccatttcggcgccttccgccattttgatggaagcatccaccgggacggtgatatatgagcagaatgcggatgcttcctgttccccggcgagtattacgaagattatgacgatgcttcttatttttgaggctttggacagaggggacatcaagctggaggatgaagtgatgaccagtgcccatgcccagtcgatgggaggctcccaggtgtttctggaggaaggggaaatgcagactgtggacaccatgatcaaatgtatcgcggtggccagcgggaacgatgcggcggtagccatggcggaattcatcgcaggaagcgaggaagaatttgtttcccgcatgaatgaaagggcggagcagctcggcatgcaggggacacattttgaggactgctgcggcctgacggattcggataaccattacactaccgcaagggacgtcgcagcgatgtcaagggaactgataaccaaacatcctgccgtttttaactataccatgatctggatggaagatattacgcacaatacggccaggggaagttccacctttaccctgtccagcaccaacaagctgctgaagcagtatcagtggaccacaggcctgaaaaccggttccacgagtaaggcgaagtactgtctttccgcaacggcccgtaaggatgatatcgacctgatagccgtggtgatgacggcgccggattataaggtccgtttcagtgacgcggccaccctgttgaattatggctacagtgtcagcgccctgtataaggatgaaaataaggatgcgctgccccgtcttattgtggacggcggcgtggcggaggatgtgggcctggtttacaaggaaggattttcctatctggatgtgaagggaaatgacctgagcgcggtggaaaaaatactgaatctgccgggagcggccagagcgcccatagaagcgggagaaaaggccggagaagccgtctacaggctgaacggggagacgataggaacggttccggtcctgtttgcggaatcggttgcagaggctgtatacaaagattatgttttgaaagttctgggatattttcttttataatggaagaaaatatgatatacttctgaaagaagagactcagaggcaaaggagtaaatagtgattcagattgtggcaggcctggcggccttggtggtcttattttttcttgttgttatcatacgggatgttaaccggtttgttacgatagagtaccatataccctgtaaggggcttaaaagaagttattgttttgcaatgctctccgatctgcacaacaagcagttcggggagcataacagcaggctgctgaacgctgtggatggctgcaggccggacagcatcctggtggcaggtgatatgctgacctcacagatgcccgcaaactatacgccggcgctggagaccatgaaggctctggccggaaaatacccggtttattatgctaacggcaaccatgaataccgcctgaaaacagatacgtataaatacaaaaatgcctatgctgattatgccggacagctcagacgtgcgggggttgtgcttctggaaaacgggaacgttctccttcccgacgcgggtatccggatattcggggcggaaatagatatggattattataaaaagctcagccgcagggaaatgaaggtttcttatctgaactcccttttgggacgtccttcctcagacgaatacaatatcctgatcgcgcataacccggattattttaaggcctatgcggcctggggagcggatttggtgctgtcgggccatgtgcacggagggatcatgcggcttccggtgctcggcggagtgctgtcgccttctctgcgcctgtttcccagatatgacggggggctttatacggaggaaaaagcttctgcggaagaaaaaagccgtatgatattgggaagagggctgggaacacacacgctgcccgtccgtgtattcaatccgggagaattgattgtggtccgtctggatccggaaagaggaagctgatggcaattgaggtaaagctgcaggtatttgaaggcccgctggaccttcttttgcatttaatagaaaagaacaaagtggatatttatgatatccccattgcggaaattacggaacagtatcttgattatatacgccagatgcagtccgaggatatgaacgtaatgagtgaattcctgctgatggcggctacgctgctggatatcaaatgcaggatgcttctcccgaaggaagtgaatgaagagggagaggaagaggatcccagggccgagctggtccagaagctgctggagtataaggcctataaatatatgtcttatgaattgagggacatgcaggtggatgcccgtaagaatttttacaaggctcccacgataccggcggaggtggcaaaatataaggcgccggtggattatgaggaactgctggcggacgttacgctgacacgccttcatcagattttccagacctgtcttaagcggcaggaggacaaggtggatcctgtccgcagccatttcggcaggattgaacgggatgaggtcaacatcgatgccaaggccagttatgtggccggatacataaagagccataaaagaatgaatttcagggagcttctggaagaccaggggagcaggatggatgtgatagtcacttttctggtggtgctggagcttatgaagacaggcgctgtttttgtggaacaggaatccatagaggatgatattattataacgaccaaagagcttccggaaggggagctggaatttcacggactgacatctctgggcgaaggcggcgggacagaggcggaagacgtggacggagaggagaaataggatggagcgcagacagcaggaggctgccatggaagcggtgctttttgctatgggggaatccgtggagattggcaagctggctgaagtgatagaggaagacgaagatactgcaaggcagatcattaacgaaatgaaagaaaaatgggaaaaggagggaagaggcgtatccattgcggaatttgaggattccttccagatgtgcacgagaggggatatgtatgaatacctcataaaggtggcaagtactccccgtaagtatgtgctcacggatacccttctggaaaccttatccattatcgcttataagcagcctgtaaccaaactggatatcgaaaggatccgtggggttaactgtgaccatgcggtgaacaggctgattgaatttgaactggtcacggagctgggaaggatggatgcgccaggaaggcccctgctttttgggacaacagagcagttcctgcgcagcttcggggtgaaatcactggaggaactgccggaactgaatgaaatgaagctggaggaatttaaggtggaggccgaggaagaagccagcttgcagctgcatttataatattgctgctatgtatttgtacggcccgggcagtaaatgcgcaggcctgtcccaactgatatgtttccagggccgcctgagcggtcataggaaaacagccgcggtgtatggcggctgcaataaacatggtgcccgaaagaggcacgcacaaaaggaggagaaggtatgataggttacatcattgccggagcagtcatcattttagtcattgctgttttattttccgggtacaagaaagcacccccggatacggcgttcattatttcgggtctccggaagaaaatcatcatcgggaaggccagtgtaaagcttcctttcttcgaacggatggataagctgagcctgaagctgatagccattgatgtgaagactaccaatgcggtccccacagcggattatatcaatatccaggtggatgcggcggtaaacattaaaatcagcagcgagcctgataaacttgccgtggcggcagagaacttcctgaatcagaatacccagtatatcgcagcgattgccagagaagtactggaaggcaatatgcgtgaaatagtgggacgtatgcgcctggaagaaatggtgagcgatcgccagaaattcgccaacctggtaaaagaaaatgcggagccggatctggcggcaatgggactcgatatcgtcagcttcaatgtacagaatttttccgatggaaacggcgtaattgaagatctgggaatcgataacatatcccagattaagaaaaaagcggccattgccaaggcggaagcggaaaaggaaattgctgttgccaaggcggatgcagaccgtcaggcgaatgacgcccggatcaattcggaacgtgaaattgccaagaaaaacaacgagcttgcccttcagaaggctgaactgaaaaaactggaggataccaagaaggcggaagcggacgctgcatacagcattcagcagcagcagcagagaaaaaccatcgaagtggctaccgcagaggccagcattgccaaacaggaaaaggaagttatcctgaagcagcgtgaggctgaggtacaggagatggcgctggacgcacaggtaaagaagaaatccgaagctgaccgttatgcccgtcagcagcagtctgaggctgaactgtatgaaagacagaagagagcggaagcggagaaattcgaaaccgaaaaaacagctatggcaatgaaggccacggcagaagcacagaaatttaccaaggagcaggaagcagcaggtatccgtatggtcggtgaagcggaagcggaagctatccgggcaaagggtatcgcagaggcggaagccatggaaaagaaggcgcttgcttatcagaaatacaacaatgccgctatggcagagatgatgatcaacgtgcttcctgaaatcgcaggaaagattgccgagcctctttcccagatcgacaagatcactattatcggaggcggagacagcaatggtgtggcttcggtggcggataacgttcccgtagtcatgtccaagctttttgaaacgatgaaggatacggtgggaatagatatggcggaaatcgtaaaggcaggaacctatgatgccaaggtaaaccgcaatatcaatatcaacggtgcttctgaggaagaaaccgccaggcttgcacgcgctgtggaaacggctgcggctgtggattccataagggagtaagggtcttcggaaggaaagggaaaagtagtgcacataaaaacggataccgttaaataaaatataacaatacaaagtgaacaggtatctgtatgcaaatgaaatattttcattcgaaatcctttcgttcgaaaaccattcgcccgagattttttttcactaaaatttatcaggccatgtttttatcctgtgttttgattctgagcccggttgtcctgttttctgtacagactatcgaggcctgtgcacaggagaatgacaaagatggtacaaccagtgaattatacgccctgtccgctgtccttatggatgcggacaacgggcgtattttgctgcagaaaaacgggacagaggtgctgcccatggcaagtaccaccaagattatgacctgtatccttgccttggaacaggccaatccagatgattatgtttccgtatcctcttatgcagcgggaatgcccaaggtacatctgggggtgaggaagggagatgttttccggctgggggacctgctctattccctgatgctggaatcccacaatgattctgcggcaatcattgcggagcatgtgggaaactgcctcgccggaggaggcaagcggagtgcggataattcagaagaggaaagcaaggaggctattctgcggttcgcgggccttatgaatgccaaggcggaggaaatcggatgtgccgatacgttctttgtcacccccaacggactggatgccattctcacctatcaggatgacagcggcaacgaggtgcaaagacagcattccaccactgccagtgacctggcccgcatcatgagttactgtattatggattctcctaaaaaagaggaattccttaccattacccggacaccggcttactccttctccgattataagctgggtgaggacggacagtgggccgccggaggcagacagttttcctgcaacaaccataatgctttcctgaatatgatggagggtgcgctgtcagggaaaacgggctttaccggcaaagcgggctactgctatgtgggagcccttgcccgggacgggaagacctttaccattgccctgcttgcctgcgggtggccgaaccataaaagctggaaatggcatgacgccaagctgctgtatgagtacgggctctccaactttgaaaaaaggaatatttacgaaaagacggatctttctccggtgccggtggaaggcggaatctgtgaggatactgtcctgcaggtacaggaacaggatatatccctgctgctttccgaacaggatgaggtacatatggaactggaggtgccggattctctgacggctcctgtggaggccggcaaaacggtgggctgggaaacctactatgtgaatggagaggtgtatgcccagctgccgattacaacggcggaggatgtcctagagctgacctaccgttattgtctggatcgcattctggagctgttctggctgtaaggaaagtcgggactgcgctcattccttcctccatgacgtccgggagcagcatgttgacaggcaggtatgtcgaattgctgctcccgctgtgaaaaaagaagggaaaatttacgttttccatctagtccttttttgggtttcgtgttatactactaaaatacgggtgctatgagtacaggccgcaggacggtggggagggttcctgatcggaaccactgtttctgggcagcagatttcagcctgcagtgcttgtacagccgtagattaaagttaacttttttattaatataaaatggagggctgaaaaatgagtattacttcacaagcgagtcaaagaattaccgctttgctcgatgacaacagtttcgttgaaattggcgctatggtaacagccagggcgactgattttaatttgaaacagacagagactccttccgacggttgtattaccggttatggagtgattgacggcaatcttgtgtatgtttacggccaggatgcttctgtattaggcggcagtattggtgagatgcatgcaaagaagatcgccggcctctatgatctggcgatgaagacaggtgctcctgtaatagggctgattgattccgccggactcagactgcaggaagctacagatgctttaaacgcattcggtgagatctataagaagcagacaatggcttccggtgtgattccccagattactgcagtattcggaacctgcggcggagggcttgcattattcccggcgctgaccgactttacttttatggaagaaaagaaggccaagctgtttgtaaacacccccaatgcacttgcaggcaatgaaatttccaaatgtgatacctccagcgctgctttccagagcgaagaagcgggtatcgttgactttgttggtgatgaggcagctattctcggacagatcagagatttggtatgtatgcttccttccaacaatgaagatgacaattctttcgtagaatgtgcggatgatctgaaccgtgctgacgcgtctttagctaactgcgtgggagatacctccatcgcgctttccacaatcgctgatgataatgcattcgttgaggttaaggctgcctatgcaaaagagatggtaaccggcttcatgaagctgaacggcgttaccgtaggcgctgtggcaaaccgcagtgaagtatacaatgaagaaggcgagaatgcagaaacctttgatgcggctctttctcctgcaggatgtgaaaaggcagcagaatttatcagtttctgtgatgctttcaatatccccgtcctatccctgaccaatgtcaacggatttaaggcggacaagtgttctgaaaagaaaatcgccaaagcagcggcaaagcttacatatgcatttgcggatgcaaccgttccgaaggtaaatgttatcatcggaaaggcatacggaagcgcttatgttgcaatgaactccaaggctatcggagcagacatgacctactgctggccgaatgctgaaatcggaaccatggatgccaagctggcagctaaaattatctgcgacggacagggtgctgacgcagtgaacgaatgtgcaaaggaatatgcttacctgcagaccagcgcagtttctgctgctaagagaggatacgtggatgctattatcgaacccgccgacacaagaaaatatgttatcggcgcattcgaaatgctcttcacaaagagagaagaccgccctgcaaaaaaacacggtacagtataagaaaggatgatacttaatatgaaaaaaaggttattagtattaggtatggctatcatctgtatcttcggcatgacggcctgtggcaaagccgcagatgaatctgctgccaatacacttggtataacggaagagggagccattaactatgcagaccaggttctggattccgtaaggaccatagtggatcagaatatgcaggaacagtatgcaggcgatgcggtggtttccgccgctctgacaagctggacctctgcgatggaagacatcggcgaattcaagtccattacggatcacgaggtgattacggacaaggatggggccactatcaatgtgatgatagagggaaccgaccacaacgcagttgtggaaatccttttggacagtgaactgacattgacgggcataacaacgaatgtacagtattccttcggagagctgatggaaaaagcggcactgaataccatacttggtatgggaactgttttcgttgttctgattcttatcagtctgcttatttcctgttttgttttcattcccaagattcaggccgccttctccgggaaaaaggatgaagatacggcggagccggaggcagcagttgcagcaccggtgagtacagcagcagccgttacagaagatttaactgatgattatgaactggtagcagttattgcggccgcgattgcagcaagcgaaggcgctgcatccacagacggattcgtagtaagaagtatcagacgtgccaataccagcaaatggaaagcaaattattaataaatgaattaacaggaggaattttcatcatgaagaactatacaattaccgttaacggaaacgtatatgatgtagtagtagaagaaggcgcttccacaggagcacccgcagcggctcccaaagcagcacctaaggcagctcccaaagcagctcctgcacccgcagcagcacctaaggcagcttccggagcagcaggcagtgtgaagattgaagccggagcagccggtaaagtattcagcattgatgcaaaggttggacaggcagttaaggccggagatgcagttgttaccattgaagctatgaaaatggaaatccctgttgttgcaccttccgacggaaccgtagcaagtattgacgtagctgttggcgatgctgttgaagcaggaggactgcttgcaacattaaactaatcagaaggaacgtaaaacgtcctaccaaagcccatgaaaatgagtttatgagttttggctgaattaacatgggaggtcaacagaatggattacatagtaaccacattagacaatctggtgcatcagacggcgttcttcaatttgacctggggaaactacctgatgatcgcagtagcttgtttatttctctacctggctatagccaagggatttgaaccgctgcttcttactccgattgccttcggtatgctgcttgttaatatctatccggatattatgctgcatgcggaagatgcagccaacggagttggcggtctgctttattatttctacaaactggatgaatgggcaatcctgccgtccctgattttcatgggagtaggcgccatgacggacttcggtcccctgattgccaatcctaagagctttttattgggtgcagcagcacagtttggtatttttgccgcatatttcggagctattgcccttggcttcaacgacaaggcagcggcagctatctctattatcggtggtgctgacggccctacttccattttcctttgtggtaaactcgggcagacaacgcttttggggcctattgccgtagcagcatattcctatatgtccctggtgccgattatacagccgcctattatgaagctgcttaccacggaaaaagaaagaaaaattaaaatggaacagctgcgtccggtttccaaactggaaaaaatcctgttccctatcattgttaccatcgtagtatgtctgattcttcctaccacagcgccccttgttggtatgctgatgttaggtaacctgttccgggaatccggtgttgtaagacagctgcaggaaactgctgccaatgctctgatgtacatcgtagttattctgctgggtacctctgtaggagctaccaccagtgcagaagcattcctgaatttggacactatcaaaatcgttgtcctcggccttgttgctttcgcatttggtacggcggcaggtgttctgttcggtaagctgatgtgcgtgataacacatggcaaggttaatccgctgattggttctgcaggtgtgtccgcagtgcctatggccgccagagtttcccagaaggtaggagcggaagcagatccttccaacttccttctgatgcatgcgatgggacctaacgtagccggcgttatcggtacggcagttgctgccggtacctttatggctatcttcggagtattctgattgaagcagccattcagattactgaactttattagaaatttaggaggaaaaggaaatgtcagacccgaaacccattaaaattatggaaaccgtattacgtgacgcccatcagtctctgatcgccacaagaatgcctaccgaattaatgcttcctattgcagagaagatggacaaggttggctatgaggcagtggagtgctggggcggcgctactttcgatgcttccctgcgtttcttgcatgaagatccctgggaaagactgagaaaattaagagcagcatttaagaataccaagcttcagatgcttttcagaggacagaatatcctgggttaccgtcactatgcagatgatgttgtagagtatttcgtacagaaatccatcgcaaacggtattgatgtaatccgtatttttgactgtctgaatgacctgcgcaacctggaatgtgcggtgaaagcctgcaataaggaaaaaggacatgcacaggttgcactgagttatacactgggcgatgcttataccatggattactggatgaacatcgcaaaagagattgaagatatgggtgctgattccatctgtatcaaggatatggcaggactgcttgttccttatgaagcagataagctgatccgttccctgaagtcagctaccaagctgcctattcagctgcatacccattatacatccggtgttgccagcatgacttacttaaaggcagtggaagcaggcgtagacgttatcgactgtgcaatttctccttttgcactgggtacctcccagcctgcaacagaagttatggttgaaaccttccgcggaactccttatgactgcggatacgatcaggctctgttagctgaaatcgctgattatttcagaccttacagagaggaatgcttgaagaccggactgatggatcccaaggttctgggtgtaaatatcaagaccctgatgtatcaggtacccggcggtatgctttccaacatggttagccagctgaaagagcagaatgcaagcgataagtatgatgaagtgcttcaggaaatccccagagtgcgtaaagacctgggtgagcccccgcttgttactccttcatcccagatcgttggtacacaggctgtattcaacgtattgatgggtgagagatataaggttgctactgatcagaccaaggatctgctttccggaaaatatggcgttactgttaagcctttcaatccggaagtacagaagaaggttatcggagatgcagaggttattacctgccgtcctgccgacctgattcctaacgagctggaaaagatcgagtccgaaatgaaggaatggaagcagcaggatgaggatgtgcttacttatgcactgttccctcaggttgcagttgatttcttcaaataccgtcaggctcagcaggaaaaggttgatatgacccaggctgataccaaaaacggagcttatccggcataagtaatgccttaagttagattttacattgacaggcggacatctcagggtgcccgcctgtttaaactgtgtgcgcaggcctgaggagagtatgaattttgtgtgagcaggaaagggatagtacgaggtgaagcatgacagaagttaaggaatacggaagaaaaattcaatattatgaaaccgacaggatgggaattgtccatcactccaattatatccgctggatggaagaagccaggacggatgtgctggagcagatagggctgccctatgataagatagaaaaagcaggaatcctgatcccggtcctgggagcctcctgtgagtacaggatttctttcagatatgcggaaaatttcaggattaaggtaatccccaatggatttaacggtattaagatggggctgaaatatgaaatatacggacaggaggacggaaagctgcatgcggcaggggaaaccagccactgctttctggatcggaaaatgatgcctgtacatttaaaacgggactatccggagatttataacaggcttgtcgcatatatgggtgactaaattgcggtaattattgggaggagccaggtacaggctcctctttctttttgcaggaaaggccgtattccctgggggaacagccgcagtatttccggaaatacctggtgaagtgctgcaggctggtaaagccgcagaggcgggccgcttcctgtacctggagggcctcgttgctcaggaggcttttggccttttccatgcgtacatggaggaggtcagtcttcggggtggtggaaaagaaatggtggtaataaacataaaactggctcttttccagattcacttcctggcagagccgctcgatggtccattcttcctggcagtttgacagcattttcaggcgaagattctggaaaagaagatagaggttttcgccatcctccttccggtcggcgcggtggagaagatcccgggagatggaaataaacatctgggatatcaggcaatgaatatactcatcccggtattctgcaagagagaaatactgcatctgtacgcttctgataaaggaatcaatctcggcagggttggagggatagaagatttcattttccggaaagccatattgtctggcaggactcaaatcggaagaaaagtgaagatagctgttgcagaaacgctttacggcctggtaatgctgaggggtctgcggagtgaacagaaggcaggcattttccttggtgatgatgagctcctcctgcagatagattttcatgggggttttcagcagaaggaacagataatccccgcttccgccggggcggaaaatcgtatcatagtcctggttaaaacggttgtattcgcaaaaatgaagagtgatcatgggtatcctcctgaggaatgtctgcggtataaaaacggcggaagttcttttcatgaggatagcatagaaccggaagaaaagtcaaatatatcggagaaaaagaactggcggttttttatttcaaagattatgatgaaaatacagatataggtaagcttgccgggacacggcggaatggagaatggtatgaaaaaagcagaattgattgtagacaaatattatcttaccggagaggtggacaaaagaatcttcggttcctttattgagcatctcgggagggctgtttatgaaggcatttaccaggaaaacagtccttttgccgatgaacaggggatgagaaaggatgttattgatctggtaagggaactgaaggttcctatcgtgcgttatcccggcggcaattttgtatccggctatcattgggaagatggtgtcggccccaaggacaaacgtccttcaaaggtggatctggcatggtctgttatcgaaagcaaccagttcgggctgaatgaattcgccgattgggctaaaaaagcgggcacggatatcatgatggctgtgaatctggggaccagaggaccggaagaagccaaggatgtattggaatactgtaattttaagggcggtacatactatagtgatttaagaaagaaacacggctatgaagcgcctcatgatatcaagctctggtgtctgggcaatgaaatggacggcccctggcagatgggacacaaaacagcaaaggaatacggtcgtattgcagcggaaacaagccgtctgatgaaatttatggatcctaccattgaaacggtagcctgcggaagttcctctctgaccatggataccttcggttattgggaagaggaagtgcttagcgagtgctatgaccaggtggattatctttccctgcatcagtattatggaaacagggacaataatacaacggaatttctggcaaattccaagggcatggatgaatttatcagctccgtcctttccatctgtgactgtgtgaaggcaaagaagagaagcaagaaacagatcaacctgtcctttgatgaatggaatgtgtggtatcacagcaatgatgcggacgctcagctggaaaaatgggtacaggctcctcatcagcttgaggatgtatataactttgaagatgcattgctggtgggcagtatgctcatcaccatgctgcgtcatgcggacagggtaaaggtagcctgcctggctcagctggtaaatgttatcgcccccatcatgacttccgataccggggcatggagacagaccattttttatccttatatgcacgcgtccgtattcggaaggggaactgttctgaatacgcaggtacaggctcctgtttatgaaagcaggacttatggagaggtttcctgtctggacagtgtatgtatctggaatgaagaagaggaagaactcactatttttgcggtaaacaaggatctggaggaagatctggaagtgaactgtgatttcagacagtttgcggattataaggtggcggagcacatcgtgctgaccaatgaggacatgaaggccgtgaatacagaggcggctccggattgtgttttacccggacacagtgaagcatccaaaatggacggaggacactttacgactctgttcggaaagcacagctggaatgtggtaagacttaagaaataaatggatgagatggcaaagggcgttttcctttacaggaaggcgtccttttttatgattttcttttaagggtgtaacatattttgaattaccgtttcctttttggacaaatgaaacaaaatgggtaaaagggaaacgggaaatcctcttgccttcccctgacagcagggctataatttcctctgacgattcgaagaaatggaaaagtaagaggtgtatcaaatggaagaaaagaaagaaaaagggaatttttggcttacggttgcgacttttatcgtaaacaaacggaaggcaatttacgttctcttttttattgctgtaatttacagcgtggcgtctatgaacaaagtatcggtgaatcaggatataaccaagtacctgcccgctgacagtgaaaccaaccggggactttccctgatggaagaacagttcctgacatatggaagcgcgcgggttatgatttccaatattacatataccagggcagaagaactggtggaaaagctggaagaggtaaatggggtaaaagaggttgcctttgatgataccgaagatcattatgcagggactaatgcgctttacgatattactttttctgcggaagaggaggaacaaatcagtaaggatgccatggaggaaatccgggatatgctttccggttatgatacctatgtgtccactgaggttggttccgaagaggcctcaagcaaggctttggaaaaagatatgaacctgattctggttctggcagtaattatcattgttacggttctgcttctttctacaaaggcatatatggaaattcccgtcctgctcataacctttggcgtggcggcaatcctgaacaagggtaccaactactggctggggaccatatccagcgttacggactccattgccgttgtgctgcagctggcgctggcgattgactatgccattatcctgtgtgaccgctttatggaggagcacgagaccatggatgcggaaaatgcggtgaaggtggctttgtccaaggctattcctgaaatcagcgcttcctccctgacgactatttcaggtatggtggccatgatgttcatgcagttccggctgggctatgacatgggaatcgtgcttgttaaggctattattttcagcctgatttccgtgttcatgctgatgcccggtattctgctcctttttgcaaaggggatcgaccgttcccatcacagatgttatgttcccaacattacttttgccgggaagctggcaaataaaacaaaatatatcattccgcctctttttgtgctggtactggttttcgcttttttgaaatcaaataactgccagtatatttatgataccagctccgtggaaagtgcaaagaaaagtgaatcgaaaattgcccaggaaaagatcgaagaggctttcggcgtttccaaccagcttgtggtcatggttcctggcggcagttacgaaagtgaagaaggggcgctgaaggaaattgaaaagctggattatgtggacagtgtcctggggctggctaatgtttccataaatgatgattatatgcttacggataagatttcacccagaaatttttccgaactgacggatcttgatattgaaatcgtaaggcttctttacgttgcctatgcttacaatcaggagcagtacggccctgtatttacagggattgatgaatatgaggtgcctattattgatatgtttcttttcctgtatgatcagtatcagcagggctatgtgacactggattcggaaatggataaaaatttgaatgaactgtatgacacgcttcatgatgcaaagcagcagcttcagggtacggattattcccgttttgtgctgtccctgcgcctgccggtggaaggggaggaaacctatgcggccctggatgaagtgagggctgtctgccagaagtattatccggggaaggaaatcattctggtgggcaattctaccagtgatcacgatctgatgtcctcctttggttcggataacctgataatcagtatacttacggcgttgtttgtcatgctgatcctgttctttaccttccagtcggcgggactgccggtgcttcttgtgctgacgatccagggcagtatctggattaacttttccgtacctgccctttcgggcagtccggtattttttatcgcgtacctgatcgtttccgccatacagatgggggctaccatcgattacgctattgttatttccaacaggtatctgcagctgaagcaggttatgccaatcagggacgctatcgtggagacgctgaaccagtctttccccacgatatttacctccggttccatactgacctgcgccgggttcctgataggtaaaatcgcttcggatgcaaccgtggcatccatcggaatcgctttaggacgaggaactttgatatccattatccttgttctgtttgtgcttccccagattctgctgttcggcgactttattatagaaaaaacagcgcttaccatcaatctgtccaaatacaataccagggaaatcgggggccggatgacggtaaacggccatgtgaaaggttttatccagggtgaaattgacgcagaaatcaagggcagcttccagggccggatgaatgcctctctggagacccggattcccgggaagcagacggagattgaaatgctggaggatggaggagaagagaaatgagaggaaaagcatgtacagggaataaaggaataagaaggcattcctcaaaggccatccgggttttggggagggtatcggcggtagttctgctgtccgtttcccttttgctttcaaatgcagaaacctgtctggccgcgaatatcgggacagggaatagtatacaggaggaagaaagcgttggagaggaagctgccggcagagatactgtcagtgaagatacggctgcagcggtggaaattgcttcacaggaggatctggtaaaactggcgcaggattgccgggacgactggtacagctatggaaaagtatttactctgacggctgatattgatttgaagggagtcgattttcagggaatcccttattttaacggaaccctggaaggcggcggacataaaatatccggctttgttctctcccgtaagggttctgatttcggattcttccgttatcttggcaggaatgccagaatagaagatttgacggttgaaggatatgtcagaatggaagggagcggagaaaatatcggcggcctggccggggtgaatttcggcacgctgtcgggatgccgttttacaggtgatgtttccgcttcgaaatccgtgggaggtattgtcggctataacaaggctgacggcaagatcgtggactgccgctcggcagggacggtaacggggactaacggaaccggaggaatctgcggagaaaataaaggcattatcaaggactgcaataacgagagcacgataaacggagaggatttaaagacaacactcaatctggacggagtggatctgggtgaactgaacctgacccagaatgtggtaacaagaaatgacagcggcggtattgcgggcatttcctccggcaccattacgggctgtaccaataaaggtaagataggatatcctcatgtgggctacaatgtgggaggcattgccgggagacagagcggaaccattatggactgtaaaaacgaaggggacattctgggaagaaaagatgcgggaggcattgcaggccaggcagagccctatatggaatcggaatacctgtcggatcgtctggaaaagctgcaggatgatcttgggaacatgaaccgccttgtgattcagatgtccgatgcactcagccagacatccagcgatgcgggacagtataccaaggcccttcagaagcagtatgaggatacgattgacagcctgaaccgggaagtgagttcccttcagaagagtatatccgatgataaacagcagacgaagaactatcttaatgacatcagtgacgcgctggacaatatcggaagtctggggaatgagaccatgcagcggatggtggacggtatgcgtaaggatatgaattccgcaatcgatgccgtaaatggtacggtgaatgatgtaaaggataagattgaaaatatcaaaccgggggatattccgggcactggggataaagacaatgaaaatgccggaggaacgacaccgggggaaacagaaaatggcgggaatgacggcggttccggaaataattccgggggaaccggcggaaatgaaggcggaggaacacaaggaggcggaacgcagggcggtacggacgaggataaaaatggaaataccggaagcggaagcggcggagatgcgggaggaaataccggcggcaataagggagaaggcggctcgggtacaacggagagcggaagcacaaatactggtgaaaatactggaagcggcggaaataccggaagcggaggaaatacggaaggcagcggaaatacggaaaacggcggagaaaataagaattccggtggagagaataagaaatcggtaagcgaggggagtgagaatccctcaaaggagccggacagtgccagagtggatagtgccggaagggttaatgcagcagctgacagtattgctgtcagggccggaggcgtaatcaggcaggctgggtacggaggcaatctggtatatgcggcggatttcccgataggaaagagcagaagcgcagcgcccgggaaaaacagcggggatggaagggcagttacctgcgctgctgtgaccggagcagaaggagaaaacgggggaaataccggaaacagtgacagcggtacggaaggcggcagcggcggaacagacagcggcacttccgacgataccggaaagcttccggatattgacaaggatgatattaaggacggcctggaggatataaaaggcaaactggatcaggaaaaaaataagatcagtatgcccgaagcggatccggaaataaaagagaatctgaataagatgaaggatgagctttcttccatatccggcaacatgaaaaacatgcagaataccatatcggacaccggagattccgtatccgatgcggcaggaaatatttccaatgaactgacggatcagagcaagctttccggggataccattgacagtctgacggattccatagacggcgggattcaaagcctgacaaacagcatgaaaggattgatgaatacccagcagcacattacggattccgtgagttcggatttgaatatcctcatggggaacggcgattcccttctggatgtgtcctcaggaaatataacggaaaaaacgctgggcgtgatttatggctgtaccaacagcggttccgtggaagcggatatcaatccgggcggaattgcgggaacaatgaatgtggagtacgatttcgatccggaactggatttggatttatccaggctgacggatgtggcagtgcgttccaccaccaatgatgtggttatccattgcataaattatggggaaattactgcgaaaaaaaataactgcggcggaatagccggcagtgaagaactggggctgatatacgattgtgaaaattatgggaatatcagcgctgaaagcgggaaaaagctgggaggaattgcgggcgtcagcacaagcagtgtcagcagaagctattctttctgtaaagtatccggagtggattatctgggcggcatctgcggagatggctttaacataagcggctgcggcgccatgtgtactctggaaaccgacagaggggaatatgtgggaagtatttccggtcatgtgaatgaggaagcggaaattgcatccaactattttgtttccggggagtggggcggcattgataatattaattattacggaaaggctgaaagctgcacctatgaggaaatcatgcagaaagaaggaattccccagggctttaccacagttacggtcacctttgagaatgacggtgatatttgcagaacaatgacaattccttacggcggagtcattcaggaagaagatgtaccaaggattcctacccgggacggttatttgaaatgggaaaaagaattcccgctgcgcaacgtgacggaaaatatgatattgaaagctgtggaacagaggtggacgttgagccttgcatccgtcgaggagtcggaaaacggaaaaccgctgcttctgcttgaagggaatttttatgagaatacggagctggagcttacggcatgcacacccccttccaaagaggaggcctgtgcttatgcctactcatggaagctggaaaacgaaccggagaaccagaaccgaacggaactgacggctcatttcctgattccggagggagctgacagcgcacagatttggattttggcggatggaaaatggaaagaggctaaaacacaaacagacggaagctatctgacggcatccattccatcgggttcatcctttgcggtatatggaaaaacggaaagcaaggttatgtattatgcggcaggaatcgctgctgcggttattctgatccttcttatggtcgcaagagcgggcagaagaaaaagaaacgtaaaaaaggcccctgcaaaagaaaaatagaatcataagccggaaaagactgaggaaatccggatggtttcccccgtatgggatcgggagcctccggaggcttaccccggtctttttttatgagaatgcgggggaaaacagattggtattcctgcagcagagtgcagttcgcgcactctgagatgcagtttgcgcattacggtattgcaggaacgaaagcgtctgctataatcatagggtagccggcagaaatgaaacaaaggtggaaacagtatgaagatcaatcagttccgggatcccgggcttgaagaagattatatggacgtccattacagggaatataatgatgaaatcaggagaatcctggctttgacggaaagcggaaacacgctttggggaaaacgggagggagtacagtcctgtctgtctccggaggaaatttattattttgagacagtggacaggaaatgcttcgcctgtctgaaggaagaggtataccaggtggagtttggcatacagtccgcggtggagcggtttggccccctgggattcgtgcgtatcagcaaatcagcggcggtgaacgtttacaaggtacgtcagctgacggcggatatgaatatgcggatgcagctgcttttggataatggggaaaaggtagtgctgaaccggtcgtataaaaacgaatttcttcagttcatcaaagaaaggagaatgcagaaatgaaaataattgacagaaaaaattactttgctactgtttgtgaagtgtatgctatgctttccatcgggaaaatcctcctggaggctttcacgcattacaaatggggaatagatcaaatgaattttattttcatgtttgtagtttcccttgcggccacctttgttttatcccagcattacaggctggacagatttccgctgcctctggtgattctggggcaatatctggtgattctgggcgccattatgcttttcctgtggatatacggacatttcggtgttttagggaaacatgcttaccgggatatgtttttatcttttacaatcccctatatcattctggcagggatctattatatgtcccttttcagagaaatcaaaaaagcaaataaaattcttgaggagttaagaacggataatgatgaaaaaaaggatgactgaaagaaaaaaaggatggctcatattaagtctgagtctggatgcttttgcgggtctcggcctggaggtgcttctggctttctggctggaacctatgatttatggaagaacaatggaacagtggaatacctggcagtcggtgctgcattggtgcatcacatgtattatatggggaagtgtggctgggtatctgctttggtcggcggatagaaattatggtctgaagctgataaaacgtgacggggacggcacagacagcctccggtcggtaaaactctggcaatgggggcttgtgatcgcagggtcggcctgcaaaattatcacctccgtcatggactggggaggctttaaggtttatatggaatggaagagccgcgggccgcttttgttccttttccaatacatatactatatgttcgaaaccgctcttttcaccctgattcttgtatttgcccagattgcctttgaaacctggtttaaaaacaggaaaataccttatgggggcattattttggggctgacctggggacttgcccatattttcaccaaaggtaatctggctataggcctggaaggtgtggtgattggccttttgttcggttctctttatctgctgttgaacagaaaactgaaatggacctatgttttgctgttccttttatttgtattataatttctactggaatttgaaatgaaaatctgataaagtttcttttggagattatacgaaggaaaggaacgaaaatatgtttccggagaagtttatcatacgaatgcaggaaatgcttggagaagaatatgaagctttttatgaggcgctcagggaagagcggcatcaggggcttcggatcaatacacttaaggcggaaacagagggatttttgaagaaagcgcctttttcgctcagtccggtgccatggacggaaacgggtttttattatgaggggacggtgcagccgggcaggcatcctcttcatgaggccggtgtttattatatacaggagcccagtgcaatggccccggcggcatttgccgatgcccgtccgggagagcgcattctggatctgtgtgccgcgcccggaggaaagagcacccagctggcggctgccatgaaggggcagggaattctggtgtgtaatgaaatccatccggccagagccaggatcctgtcggaaaacatagaacgtatgggaatccggaatgcggtggtgaccaatgagacgccggagaggctggcggaacggtttgccggtttttttgataaagtcctggtagatgcgccctgctcgggagaaggaatgtttcggaagaacgaagaggcctgcggggaatggagccctgagaatgtggaactgtgcgcggagaggcaggataccattctggacagcgccgcgcagatgctgcaaaatggagggctgctggtatactctacgtgtacctttgccccgcaggaaaatgaagggacaatcagccgtttcctgaagcggtatccggcgttttccatagtgaagcccgggaagccggaatgcttttccccgggaaggccggactggataccggagcctgctccgggaatagaggctaccatgcggctgtggcctcataagctgaagggagaaggacattttctggcagttctgagaaaagaagggacgctttctgatatctcttctttaccgatccggaaggacggaaacagaggggcttcagaaaaagaatgcggggaattcctcacgtttgcatcacaatccctgaaaggctggcagggaggcaattatcttttcttcggtgaacagctttatctgctccctccgggaatgccttccctgaaggggctgaaggtgctgcggcccggactgcatctggggacgatgaaaaagaacaggtttgagccgtcgcatgcgctggcgctggccctgaagccggatgaggtatgtctgtctgcggaactggtttccggggaagaaaacaaagattacggccctgcatttgcctggctgaacggggaaacgtttcctttaaccggtgaaaagggctggtatctgataactgttgacggctacagtatcggatggggaaaactggcaggagggattatgaaaaaccattatcccaagggacttcggaaaaactggaggtaaagccgccatataaataaagaaaacggcgccgaggcaccgttatgcatgggacaatccggggaagcgcagcttttgctgctgaaacggattgtcttcttttgtaaggaagaacagagtgccgtcatcatccagaggagtctgtacgcagtctgtggtctcttttggagtaaattcaagaatgaccctttttgtatccgggaaagacagaaaattcagaatctcccggaaatttacatctgctctgcaaaaaatatcatggcagatcatggtattttcttcctctgccttttccacaacggcaacagcatcgtattttggcagataataaacacagtctttaaggaaggaacgaagatagaacattaaaagcggatagttatccagcatgggcagaagcgagaacggattggacatttggtaatgctctttcaatatacggcgatcttccggtttgtccatggagagtttccgtatcactcctttttgggggaggacagggaggctgcactgatactgttcctgcctgctgaacccaaatttgggatagaagtcaagaacggtgtcgttggcaaagagatacatgccgtcacagcgcccttcccagtctttctttatttcctccatcagaaagcgtgacagcccctgcttccggcaggacggggctgtcattaccgtaccaagctggatataattttttatttgcccgttccagattgttttcattgtgtttacggaaatattggcagcggctgtatccccgtccataagggtataggggatgtaagcatccgtccagtagccgttttcataccagctttcaaaggaaagctgaaaaacctgtatcgccagttcgttaaatgcttttcttgccgcaggattattacgtacctttttttctaaatgccagttcatgtttataactctctgccttccttttccagttctttcagccgttgattccatttttgggcctcatttttattatagagatagaagagcgcccatatcacgataaaactcaggatcccgacggcaaaaaatgcggcaaggctccagcttaattgcctggggatccattccagataaagggcggtaagaaaatagactcccaggcccaccgtgaaatgaagtagaatctgaaggctgcgggaaagcttttccatggtatatacaatacttgtgcttccgcatgcgattcctacgataacggagcctaatgcctgtttgggaaactgctccatgatttgctccagataagcgcttccgcccataagataaagtacgaggcatattaggacaaaaaaggtacagccccaggaaattccccaatataaatatttaactgctttaatcattgtttttttcatattcatacccccaatcgttctttgaattgtttccggtagcttctggttatcacttcctccgcaccgtttttcatcaccagctccatggtaccgttaaaggaggcctctacatggctgatctgccgtatattgacgatggctgatttggaaatccttacaaaactgctgccgagctgcttttccagctcatacagcggcctgctgagaagaaaccgttttttctgcctgtcataaagaacaagctcccggccttccgtacggatcaggtctatggtatccggatctagaagataggttttcccatcccgctgggcggaaaaaaggatttcatccccctccctttccagaaggctaacagcagtctgcagggagggtgtaagcctggcgatatgcagaacggcatatggatccctgcagtccggttccactttaatttccactctcattaagttacctcctgtatatatgttctaaagatagtatagcatattactttggaaaaaacgtgcgctttgcccttcagggaagcatcttacaccggaataaagcatcttaccgccggtgaagaaaaaaggagctgataatcacattttgcataatggattatcagctctttaaaaataatatttgcggttaaacatggccgcttcttatcgattcagaaatctggaaatcgtacggataacaaggtttatatccagcggctttgctaaatgagcgttcattccaactgccattgccgcttcgatatcttctgaaaaagcatccgccgtcatggctaaaatgggcactgtacgggcatcggaacgggatagctcccgtattttatgcgtggcggtataaccgttcatctgcggcatttggatatccatcagaatcagatcataatagccctccggggatcccgtgaatttttcaacacactggagcccgttgcagacagagtctatgacggctccggtggatgtgagaagcacctccgcaatttcacggttcagctcattgtcgtctgccagcaaaaatgtttttcctgtaaaatcaaagctctgcttttgtacatcctcagtctgatccgtgtcctgatccagcagatattttttcagactggcggcaagagtggagcgaaagagaggtttttgcagaaaaccacggactcctgcggcttttgccgccggttctatgtctgaccaatcataggccgatatagctaatattggcgaggcatccccggttttttcccgaatgagccgggccgtatccacaccgctgatatccgtaagctgcccatccaatatgacggccctgtaatccctgccgcttgcgtgggcttcctctgctttggataaagcttcatgtccggagaccgcccagtccgcggaaattccgcattctcctaaaaaacgggagctgctttcacaaacctccctgtccgcatcggcaatcaacactctggcgtgggggagctgtatgcctgccggtgttattcggcctatctggacaggaagtactacggtaaatgtcgttcctctgcccacctgactttccacagagacagtaccgcccagcatatccatgactttcttcgttatagccattccaagaccggtgccttcagcctgttccattcggctgtcatactcacgggaaaacgcatcaaatattttatcgacaaactccggattgattccgattcctgtgtcggcaaaggtaaaagtataaacggcgcgatccgcctcctctgcggcgcattcctcaatatccatggcaatagaacctcccacgggtgtgaatttgcaggcattggagaggatattgataaaagcctgtctgagccgcagcgcatcacagtagatattttcatgtattacgttttgcaggcggactgagaactgctggtttttggccttaatatcaggctgcatgatggtgaccacattctctatcagctcaggcagaagcatggggccgatattgggcgtaatttttccgctttcgattttggacatatccaggacatcattgatcaggctcagcagatgctggcttgaaagttcaattttcttcagacagtcctccattttttccggctcctttatatgggaaaaagcgatttttgtcatgcccacaatggcgttcataggggtacggatatcatggctcatgcgggagagaaagtctgatttcgcaaggtttgctttttccgccttatccagtgccttgttaagcatttccgtgcgttcttccagtttacatctgagttcacgcagtacggtaacatcggtaatgtcgataaaaactgccagatagacaggatcggcggcgatcgtgtctatgcaggaaaagctggcctgaaaccagcgatcctgatcggatttgtccttcatatgcagggttgcttcaaaatgctccctgctgcgcagatgagaaaattgttcctgcattaattcctggctttccggcgccagtacgcggagaggatcggcggaggacggatctttcacatcaaataagttcccgatccggtcgctggcttccagtattaaaagggaatcgggggtaatccggtattttacgataaacccgggaatgttgtcataggcaatggtgcgttccttttgtatctgcagcatgtcggttacatttaccatggtggcgtaggtaacctgcctgccgtcaatatattcatccgtgaaaaagcccaccagcttaacccaatagacggagccgttgggatagtacatgggtagaaagacactgtagctgtcatcattatctgcaatcgtggcttcgatttttttatgcaggatattccagctgtccgaattatttgcaaaaaattcatccacatggtcatggaatatggaatggcattcttctttcgtatagccaatcagccggtagtaaaattcatttgccctgatacaggtgaaatgctcgtccatcagatgcttgctgacgctgacattcagggcgctcatcagcatatcctgttcctggcttacctgttcaaaaacccgctggaaatgctgttccttttccaggcgcgtctgcatcatttccgtgatatccgtcatggtggtataagaaacgcggcagccgtctatgtattcatcggtgtaaacagactttagctttacccagtacttttctccgttggggtagagcatgggaatatatgccgtgcagctgttttcccggttggctatggaggccctgaccttttccgttattatctgccacccttccggattattggcaaaaaactcatccggatggttgtggaaacgggcttcatattcctctttggaatagcgaatcatctgataataatagtcatttgcccaaatacatgtgaaatgttcgtccgccaaatgcttgctgacgctaacctccaaaacattcataagcaggttatattcactgctcagctgttcgtagttcaaattatccgacattgggtattcctcctctgcataattgcctactgtttctttggtatagcagcatttggcgatttcctagtgctgtctgtctgccctgatgcaaagaccaataattaaaacggtgtgagcggcagaaccggatggaaggcaggagaaaaccggcctgtattcttaatcatgcaggagacggtttactacacaatttcggttctgttgtggggatataaaaaagagcacaacagattttcggttctgttgtagccacattgatcgaataggctttatacatattaaactataccctattggcatggaaattggcaagtatttctcaaagattatcgatataagatattcccggacatgaaaaccagcgagaaaaaaaggaacttttatctcgcttactttgttgtaccctgaattcggaaaattttattttatacgctaaaaatataccggcagatggtttatttaaacctactgttaatcaggcaatacattagagaaatgtggctacaacagaaccgaaattatgtgataatcagcccgatacgctccatctgccgggcatggaccgtgccgctctccatggtatatatgcgtgtcgtattgacgttggagtggcccagaatatcagccagccgggacagatccttttcaagtgtgtagtaggtccgggcgaacagatggcgcaggttgtgaggaaataccttttccggttctacatctgcactttcacacaaggctttcatatcacgccaaatattagaacgattgagcggttttcccgtcctggtgacaaaaacggctccggttgttcttttttcttttttcaggtactttttcagcagcctgcacagcttgccgggcagaaaaatggtacggcgcttgcctttgttgctgatttccgccctgccggactgaatggcttctgctgtgatgaactgcagttccgacacacggatacctgtggcacagatggtttggataactagggacaggcgttcgctgccatcctgttcggcggcgcgtatcagccgtatatattcctcacgggtcagctccttttcaccgtcggaaaacagggacctctgaattttcagcggtttcacttttaatgcagccaggccgcagaaatccaggagaccgttcattgcggcaagcatggtattgatactggaaggagcgtactcttctgtcaaatggcctttccagcgaagcagggcggttttggtgagttcctgtccttccagatatttgtagagggcggtcagatcgtggatatatttttcaatggtggcggtacttttttcctgttcctgcagatagacactgtattggcgtatcagctcgggggtaatcgttttcagttggtctttttttcgcatgatgttttcctccatatttaaaatactacactattattgtaccgtatcctctgaaattcatacgaatggccttgtataatataaatccctctgtctatagcttttacataaaataaggaaggagaaaaaagccgggtgtcagctcggctttttttaagtgtctttatagtatgtctgttagtatcttcctattaaataaagtatcaggctgcgttatagagtggaggaatggaggaaatatatggacagaagagccgtgaaaaccgccgttttactgctggccgctgtttgtatactggcggcctgcggggaaaaggaggaggaagaaaaccgacaggcaaggatatgtgtaacgctgcaggatgcaaaaggggctgcactgcccggcggtgaaatagaagcggaggaaggcagggaaatacgaaaatgggttgcggatgacagaggaatacttgaaatttccgggtggaaggaagatgaaataatggaaataaggatgtacagcgcttcaggaacagaactgggagaggctgttttgaaaatgctgacaagccaggtcacggatgcggctgtgctggagaataatcatatccggatttgtgcggcaaggaataccgccagcgtggatgttattttccggcctgatgggatgggagggatcctgtgcagtctgaagctggactgaagaacgatggctgtaagagcttttgccgggggccggaaagaaatatataaattaaggaagagacagcagaggggcggtatgacagaaccgaaggcataccgggaatgaggacattccaaaaccgcacacacggatccgcacacagactacacgtacggatccgcagatattgacaggaaaacatggaaattttacaataaaggagtatttatggaatattttgaaatggatattaccgaaaaggaaaaggatctatacggggatcagctgatactgcttacgggaacgcttacggaatttctatcctgtatggaaatgctgaggcggtaccggaaagccgttacaggacgggatccggtgtcctcctgccgggcgcgtattaaaaaagcggacagcatgacggaaaagctgcggcgtatggacctggaggtctgccgggagaatgccctgcagaaagtgtacgatgcagccggcgtgcgtattatctgtccttttgtagaggatgtatacagcatggtggatttgattatggaaattccgggggtcagactttttcaggcaaaggattatattgccagtccgaagcccaacggttatcgcagttaccacatgatcatccattttcccctgcgttttatgggagaggcaggagcggataacagcctctggctggagctgcagctgagaactatcgccatggactgctgggccagtatcgagcatgggctgaaatataaaaaggatatatccaatcaggagtttatgaaaaaagaactgaagcggtgtgcggatgaaatcgcgtccacagacctttccctgtcaacaatcagggaaatgatccgggaaaatcaggaaggaagggacggggataaatgcgtgtattgatagcggacgatgaacgggaaatgacgcaggctctggaagccattctaaagcatgagcattattccgtggatattgtgtatgacggccaggcggcgctggattatggcctggcggaaacctatgactgccttgtgctggatattatgatgcctaagcttaacggcctgcaggtattggagcggctgagggaaaacaacatttccacccctattttgctcctgacagccaaggggcaggtggaagacaggatagaggggctgaactgcggggcggatgattatctgccgaagccctttgatgtgggagaatttatcgccagggtgagggcgcttacccgcagaaacggggtgttcacttcccatatactgactgtggggaatatcagcctgaaccgttccacctttgaactctcccgtgatgaaatggctgtccgtctgggaaataaggagttccagatgatggagctgctcatgaggcagcaggggcgttttatttctacggagcagtttatggaacggatctggggctatgagagcgagagtgagatcaacgtcgtatgggcatatatatcttacctgcgcagaaagctttccgctttgggcgccaatgttaaaattacagccagccgcggacggggctacatgctggaggtggaggaaaaagaatgattgaggcgctgcgcagacgattccttatgattgcaatgctgtccctgacagggacgctgtgtgtgataggggcatccataaacctgggaaatctgtaccggataacaaggctggcggatacggcgatcgaacttctctatcagaatgacggaacctttccgctttcggatggagaacggcctgatgtggcgggcggttttcagattacggaagaaaccccctttgaaaccagatactgcattgttcatctgacaaagaagcgggaggtgcgggaagtggaaatggagcacatcgccgccctggatcgggaaaaggtggtggatctggtcagtgaaataatcagggacgggaagaaaagcggatttaacggctattaccggtatcaggtttatgagaagggggaggagagcaccattgtggtattgaactgctttctccagctgcagtcggtctacaacgtgcttcaggtgacgctgctggttatcgtatgctgcgtgactctggtttttttcctgcttctgcttctttccggcagggtgatccggccttttgcggaaaatatagaacggcagaagcgttttctgacggatgtctcccatgagctgaaaacaccacttggcatcatatccgccaacaccggcgttctggagcttacaaagggaaaggatgaatggacggagagtatccgcaaccaggtaaagcggctggacagtctgattaaagatctgatagagctgtcaaaatccgaagagtatgtgaaggagagcgaatttaccgaattcagtgtcagccagattgcggaaaccaatgcggattccttccgtactctggcccaaatgcagggaaagcagcttaatgctgaaatcgaaccgggtgtgtgtatgagaggccaggaggattccatcatccgtctgatgacaatacttttggacaacggggtaaaatactgtgatccctcaggcaccgtggagctgcggctgcggcagaaaggcagacaggtggtgctccaggtggccaatccatgccgggatatggatacggcccaggtcccccatctgtttgaccggttctatcgggcggacagttcccgttcccgccaaagcggcggttatggaatcggactttctattgcaagggcggtgacggaaggccacaagggcagaatcggggcggcctatgaagccggaaatctggtgtttacggtggtgctgccggggattgccgggaaaaacatacagctttgacaaagttcacaaaattttcacacagattccgtaaacgggggccgtttgcggagtctttttttaagttcatttatacttggacgtatataatttcaaatacaaaaagcagtccgcgggcagtggggaaattggttttcaatcttagccattgcttttgcgagaataagaaaaaaggagagataggaattatgaatggatttgcaggttcgcggaggaaaacagccatgcatataatggcagcgctggttttgccggtacttttgcttttgggagccggcagggaggtatctgcggcaggagggctgcagatgagcaccggatatccgggaatgtcggtgacggcaggggatgaactgaccttttcccttgatttttcgaataccacaggggctggtatgtcggtgtccctggagacggtatccctgccggagggctggaaaggctattttaccggaaacgggagtgaagtgagccaggtatatgtaaaaagcggtgataatgacggaaaggcagtctataacctgaccataccggaagaagcggcaggcggagattatgaggtggtcctgcgggcatatacagcgggagaggcctccgatacgctcacgctgaacctgaaggtgacagaggaagaggtgggaggcagcagcttccgatccgaataccctgaacaggaaggggcatcgggagccagcttcagctttgatgccacactggtgaataacagcgccacagagcagaactacagtttttcatccaatgctcctgccggctggagcgtgacctttacaccctccggagagagcagcccggtcaacagtatttccatggagccgcgtaaaagccagacgattacggtaggggtaacgcctgctgccgatgcggaagcaggggcatataccatttcctgtgcggccgtttccgcaggggagaatctcaagaccgatcttacggcaaccattaccggaaaatatgccatggacgtgacaacacccagcggccggctgagcaccgaagcctatgccaataagcaaaaagaagtggctctgaaaatcgtcaataacggaaacacggatctgacaaatgtgaatctgtcatccacggcccctgacggctggaatgtcagcttcagccagccggtcattgatgtcattgaagcaggtgcttccgtggaagtgaccgcatacataactccgggagaagacgccctttccggcgactacgtggtttctgtcaaagcctcaaattccgatacctcggacagcgcggaattccgtatttccgtaaagacggagacaatatggggcgtggtgggcgttctcttgatcgtatgcgtatttgccggccttggctgggtattccataagtatgggagacgatgattatgtcagaaacaataattaaaacagaaggactttccaagcgttacggcggaattaccgcggtggacaagctttttctggaaatccgcaagggcgaggtcttcggcctgctcggaccgaacggggcaggaaagacaactaccacgctgatgcttctggggctgacagagccatccgggggacgagcgcagatctgcggttatgattgcaccagggattcccttcaggtgaaaaaaataaccgggtaccttccggataatgtgggcttttacccggatatgaccggcaggcagaacctgcggtttacgggccgcctcaatggcctgcagggtgaagaactggaaaaaagaattgacgaaatgctgaaaagagtgggcatgacaaatgctgccgatcgcaagaccggcacctactcccgcggtatgaagcagaggctgggaattgcggatgttctgatgaaggatccccagattattattatggatgagcccacgctcggaatcgatcctgagggcatgcgggagcttctcgcccttatcaggcagctgtcggaagaagatcaaagaaccatactgatttcgtcccaccagctgcaccaggtgcagcagatatgtgaccgtgtgggtatttttgtaaaaggaaaacttatcgcatgcggttcggtgggtgaactggcggtgcagctgcagagcgaaggaaactatattctggagctggaggcctatccccatgacgacaggctggaaaacctgcttcatacagtggaaggcgtaaagaaaatcgcaaaagaaaacgagatgattcttgttcattccgacagagactgccataatgatgtgattgtgacactgctgatgaacggctatgatttgcgcagactccgccagcgcggcggtgatctggacgaaatatacagtaaatattttgaaaaggcaggtgagacctatgacagcgatacaggtaaaagaaaaggtttccgcgacaatttcaggagccttgtccggcatgcatcgggaaaaggaaaatagctctgtccacggactccttgtcctgttcaggaaggaactggccgaccatctgcgcagcacccgtttcctgctgatgactgcgctgctgactctgactagtatggccagcctgtacggggcgctcagtaatatccgggatcaggctacggaaaacagtgaatttattttcctgtccctgtttaccacaagcggaaattccctgccgtccatatgcacctttctggcgtttctcggcccgctggcagggattgtcctgggctttgactgtatgaaccgggagcgatccctggggacactgaacaggcttacagcacagcctatctaccgagatacggtgatcaacggaaagtttatggcaggctttgccgcgatttttcttatggtattttccctggggattctcgtgagtgccatcggcctgctggtgataggaattgccccgcagacggaagaggtgctgaggatactggcctttctgctttttaccgttttctatatcgccttctggctggggctgtccatcctgttctccgttatatggagacatgcggcaacggcggctctggcagggatatccatctggattttcctttccttctttatgagtatgatagcaggcgcggtggccgatatcgcttatcccacagaagggattgaagggttatttaatctgaaaagcaattattccctggaactggggctgaaccggatttctccctattatctgtttggggaagcggcgtctaccattttgaatccgaatatcaggagtatcggaatcgtcaccaattcccagctttccggagccattgcgggatatctgcccttcggacagagcctgctgctggtatggccgcatctggtgtgtatggtggcgctgactatggtgtgctttgccctgtcctatatatgctttatgaagcaggaaatcagggcatagaaagaatgcctccgaattaaaattcccgtggaaaaaatgtctccgtgcagttataatgaatctgtatagaaaaatgcttttcccggcaggcggggaacggaaggggagtggaagtcccaatccgctgcaggcccggcctgccggggcgataggaaaaggagacgaaagatgaagcaggacatgattgtaattctggacctgggaagtaccgaaaacacggtggtggcacgggcgatccgtgacatgggcgtatacagtgagatccatccccatgatatcaccgtggaagagctgaaagctctggacaatgtgaaaggtattattttaaatggcggtgaaaaccgtgtggttgacggcagaccggttgatattgaccccgctttgtatggctgcggcgtgccggttatggcaattgaccatcccacggcacagtgcggacttcgctatccttccattccgaaagaggaagttctgaaggatttcgtactgggacagtgcaaagcggaaacaaactggaatatgaagaactttatcgaagaccaggtggaactcatccgccgccaggtaggagataaaaaggttctgcttgccttatccggcggcgtggattcctctgtggtggcagccatgctgattaaggctatcggccagcagctggtatgtgtccatgtaaatcatggcctcatgcggaaaaatgaatccgaaagcgttgtggagatattcagggatcagcttcatgcgaacctgatctatgtggatgccacggaacgtttcttaggtaagcttacaggagttgcggatccggaagaaaagagaaagatcatcggcggagaattcatccgtgtcttcgaagaagaagcccgcaagctggacggcatccatttcctgggacagggtacgatttatccggatattattgaaagcggaaccaaaaccgcaaagatggtaaaatcccatcataatgtgggaggactgccggaggatctgcagtttgaactggtagagcctttaaaacagctgtttaaggatgaagtaagagcctgcggtattgaactgggactgcctgcggctatggtataccgtcagccgttccccggccccggacttggcgtgcgctgccttggcgcgatcacacgagacaggctggaggccgtaagggaatcggatgcgattctgcgtgaagagttcgaaaaggccggactggataagacggtatggcagtactttactgtagtgccggacttcaagtctgtcgggatgaagaaccatgcgagatgctttgaatatatggtgattatccgggcaatcaatacgattgatgcgatgaccgccagcgtggagaaggtggactgggaagtgctggagaagattactaaccggattctggcagaggtggagaatgtgaacagggtatgctatgattgttcgccgaagccgccggctacgattgagtttgaataaattgagatgtcgaagaaatccagtggttttggaattagagaatgattgacaggtggttgtgcagcaagatgttcagagccattagctgtgggtagaaactcatagctaatggcttttttgcggtttttttgcggtagttttttcctttgggacaggaagttcttcgtacatagataaaaacaggctgcaaagaaattctttgttgttaacatcatcgactaagagcatttcttttgccctctcatacggcaattcataagcagacataggcataagggcgattgcggaaggaacaggttttacgagtaccgatcccacctcaatatagattactgcaacgagagtattaagaagaaaacggtacttgcccgttgctttgagggggaggataactattataggttgaatacaaagactataaatttttgcggaaagtgtttggaagtaagcagatggacagtctgttagagcgagcatgcacaggaatgctttgaaatgctcacagagcagatgaaacaggcacagggtattacggagcagctaaaggcggaaaatgccttagaatggacagggtgtaaaaactctgtctgtttttgtatgaaaagtaaatttttgtcctgcttgacttttggaaaattgagtgttactatatctatgaccgaaatagtattttgagtcatagcggggagattgaattatggcaaggagcttttctgaaagagaaaaagaaaatattagaaaaagtttgatggacatttgcaaacagaactggacacagtatggctataaaaaaacaagtgttgatgaaatatgtaaacaggctggcatatcaaaaggagcattttatcttttttttgagtcgaaagaagctcttttttgtgaggtgttatgctctgtacagcgtgaaatttgtgaaatggctgcagcggcaatggaagaagaaaaaggaaaaccaggtgtggtaaaagccttgaaacttatctatcgggcttatgataagaattcttttttgtacggttcggatactgctgactatacaattttaatgaacaaagtatcagaggaacaggcaaaagaaatggaacaagcaggagaattaagcagacaacttttttctggtcaccctgatttgaaatttagagttgatgccaatatggctatttccgttatctattcactgattatgaatatcaaaaataaagatgttttaccgcaaaatcatttggaagtctttgattttatggccgaccatttgattgataatttatacgaataacaggaagttgaaaggaacaatcccaaaaaagtcagcgggtcagatgatggatttgacctctggcaatgtaaaaaaacaatttgcgctacttccattcctatttttttaggaacttttattgcagcagctttacaatgtcattgacgcagttattgcaggtcgtttggttaatgatagtgcattatccgcaataggtttttcagttccaatataatctattgcggtcataataacactgtccgctgctttattactgggtggaaagcaaatattgggattgattattggtaataacgaagcaatgattttacgtggttatagttacttcaaggtttgattgtggttttattcagttaatgccataatatacggcttaggtggcgtcctgtcaggaacaggcgatagcttcttgctgcggatggtatgtatcaagggtaattgtgctttgtgatataaaagtaatcgttggcaaacaaaatcggtaataaaaacaatacaaaattgatggaggttaaaaatggaaacggaagttgtaaataagaataatgtgtctgttgctgttattcatagcgatgaacacttaattacagatgttcaatcagcattagatttaattatgtctgtaaaatatgaaactggctgtactaattttgctttaaataaaagtgcgattgtagatgacttttttattttaagcacctgtatggcgggagaaatattgcagaaattcattaactacggtgtgagatttgcaatatacggagatttttcacgatatacaagcaaaccgttaaaagactttatgtacgagagcaatagaggaaaagatatttactttcagccaagtgtttctcgtgctgtggataaactctcgggatattccaaattaaagttataatttggcttctggaaagagcagttccaccgtcaggaacaagatgcggaagggaagtgccttaattaaaggccttcccttccgctatttgtcagtacgatacagtcatagcggatcgtttttcccttaagggaataatcaggcttacgatcagccagccaggctcctttcagcggccttttgataactatcttgtacggagcactggcaatagcagcatgcagcagcgcatcctcatcagtacagggctgttccaactgctggagcagctgaaacttctttttaatcagtgcgcttttttgtctggccggaaacatgggatccagcaggacaacatccggcctgaatccaagctgaggcaatgcggtcaggctgtctgtttcaaaaaactccattcgcccaacaattgccgccagatccggaagttctgcggcccgggaaagcgcgtcgcgcagaagtgccgcaattacgggatcacgttcataaagccgtacggaaaagcctgctgctgccagcaagaaagcatcctcccccaatcccgctgtagcgtcaactgctgtcaggccttcagctttccctttgattttagaggcctttatcaggagttccctgttcagattgccggggttgatccgtgatcgcatccgggtaaaatcgccccgcagcgattgactgtttcctgctagagtgagaccgtccttatcgggacgcagtgttaaatctgtattttttccgtaagcatctttttttataatatctgtaattaattgctcgtcaagctgtggggacacttctctatccatgtcacttttggatatgatttccatatctttatcatctaaatcggacatatgaaattctccttgcgtaaataattgttataatatatctattctaacaaaatttaatcctattttctattattaatatatacaaaggaaaggttgagtttgtatgcattaaaaagatttaaataccatcgtggatagtcaggcctttttgattagaatcatcttctgtgattatgccattttaaccccaaaaggctacagtatgccaaagctgttttttcagttggacattttatttatgtcaccgatatcactccaattatctatgcacagttggcaatcacgcgatgctttaccaataagataggcatttacaattcctttgtcatttccaaaacaatatccattctttgagctaaacagccagtataactggaattagtacttgatgttacaaacagaaaacgaaataaattataaccttaacattaaataatatcaaatctttgatataataagatcaccacaaatatatcatataaaaaatatttattttatgatatattaaaatactcaaaatgaaaatgccccaaaccagttattcaacaccattaattatcaatgattccatttaagataagaaagcgggaggtatgcacaactaatggcaataaggtattggacgattatgaagaactaaaggagtggcggtataatgaagaataagccaaaaccagcgtgcagatttatgagttaacggatgtttgatacttattctcttttcaacgcagagaaattatggcagaatagaaataaataaatatctttatccaaaaggtgtacgacagattctttatataacaaggggaataaagagatgagtgtaataaatagaatgtctgaaattatcggtcttgcaccaatttcagataagatagaatttatctgcgattccgttgttgattgtgatgcttacacaagaagtaaaattgaatatctggtaaacggccgcaatatccctgcttttctgcttattccgaaaggtgaaggaccgtttcctgccgttttggttaatcatcaacaccatagccaacgaaattggggaaaaagtgaggtttgcggactggtaggtgatccactgcaggattttggaagtaaacttgctcgtgcaggttttgtcgtaattgctccggatgcaatatgttttgaagaacgaagagtaaacgcagtgggcacggaagcaaatcacaaagaagatgaatggaatcattttcttgctttatgtcacggtattttgacaggagaaaccctggcgaaaattgccatagaagatgcgataggtgcagtaagtgttctgaaggcctgaatattgtagataaaacaaaaataggctgtttaggccattcttacgggggaacaactacattttttgcggcagcttttgataaaagaataagctatgccgtgtcaagcggaagtgttgtcagttacaaatatcgtatggataattcgacaggaatagaaatgtccagtattattcccggatttctaaaagaatttgaagtagcagatgtaataaaagaaatagcgccgagacacttcctgatagtttgtgctgatgaagataagtattcaaaggatgcaccacaaatttttgagtctgtgaaagaacactatatttcaaaaaatgcggagagtaatttgtatatgaaacaatataaaggcggtcatcagttgacgcaggaacgttttgactatatattgaaatggattatcagtttttcctaatgagtattatacttagaaggtcggagggaagacagatggaaatttggatatccccatgtaactgttaacttcgtttataaggaaactatatggcaaaaaaatattttattggcggttcaccatgcagcggcaaaagtacaatagcagaaatattatcagaaagatatggacttcaatactttaaagttgatgatcatctggaagaatatacaattcgtggggcggcagataatctccccatttgtaaaaagcaaatcgaatggaatgcagaacaaatatggatgcgggatccggttttgcagtgcaaagatgagattattttttatgaagaaatatttgattatatatgggaggatttaaataaagtaaaccaaaagggagccgttgttacagaaggggcagcatattttcctcatataatgaagaagctgcatgtaccggaagaacagtacgcggcgataactccgaccaaagactttcagatttctcactataaagaacgggaatgggtgccttacattttagaaggatgcagtgataaagaaaaggcatttcaaaattggatgggcagagacagtctgtttgctgatacggtatgtaaggaatgcatggaattaaactatctttcgatcgttaatgatgggggaaattcgatagatgagatggttcagatagtttcagtgcactttggattgaaggtgtagcaggataaaagaaaaataattttttccaaatgctgaagcaggagatgtattttatatcagatttatcgctgaatgaaaaaacggaaatatgggggataaagcttatgacaattcttgaacaggttagtcatgaaacgatggtatttatgcgcggtaagtatcgcctggatgaaatcggagacggcaaagatgaattaaagtttaagcaagggcagaaaactattcttacagtgtacacacacgatgataaattcacatttttgattatctttggaaaaaaagagcgtgaatgttttgaaatgcagaagaacgaattttcaacatatatacatgattattatgataactcaaaaacttaccatgatggaaaatggatgttcattgatgtaagtactttggaacaattagaagaagtcaaaaagcttatacttatcaaaaagaagcccaaccgcaaaccttttaaaaaagaaaatgcgttatattccaaatgtggccaacgctgtgatttatgtgttcattatgcagatttagatgaggatatgcgggatattatgattcctcagctgattaagatgtggggacagacagattggagcatgcgctgcgaaggatgctatagtgagaattgctattgtaaagatgagccatgcaatgcaaaaggctgcgcaccgcagaaaggattggcggaatgcagagaatgcggtgaattcccatgtgttaaggccacatcagcagattatcgttcgatgatacatacagaagttcattatgcagatgaaattacatggggcatacttccctatgtgcctatgcagtatgaagagcagtagacagagtagtaaaatcctccggatccttttggggtttggaggattttttttattagattatttttacgactattccgagacgatatggtataattagaatgctgtaaaatgctgatatccggaaagcgggatgaattgcgcagcgagtgttatcatacagagaagataacttgaccgtgttcagataatgtctgccaattttggacgtttttccattacaaacaagatagcaattaacaagatgaagtatcattaattttccggagggttaccatatgaagaatttaatcagacttaccgattacaaggcaaaagatgtatatgagatatttgatatagtcaatgaaattatgcaggggaagtataaagatattttgaacggaaaaacagtagttttgttctttccaaacagcagtatccgtaccagagttacctttgaaaaaggaattcggcttttgggcgggcaagccgttttattcccgtcggataccttggacaagaaagagaatagtaaggatgttataggatatttgaataattgggccgatgtaattgtagtgcgtcataaggatataaccatgctggaaactatgtcgcaatattcaaaggttccggttatcaatgcccttacagctataaatcatccctgtgaaatgcttgcagatatgtatgcgctttcaaaaatcagaaaagattttacaaaggataagtatctcttttgcggcctgaaaggaaatatcggattggcatggaaagaggcggcagatgtcatgggatttgagttatcccagtgctgtgcggacggatatgaaatggaaggaattccggtatatcataatatagaggatgccataatcggcaaagatattgtctgcacggattcgctgccatcggatgtacttgaaaaatcttccgattgccaggtgacaaaagcagtcatggaaaaagcaaataaaggtgcagttctgaatccatgcccgcccttttatcgaggggaagaagtatccggcgatgtaatagattctgagtactttgtgggatatgagtttaagaaatatttgctggagattcagcaggcagttattatatattgtatgatacattaatatttatttgagcagtggataaaaacagtatatgcggttatatttactgcttatattatggcgggaattggattaatgttcaatgaaaagttcggcggaaattgacatttttctacaaaagtgttaagttatatgtataaattttagcaaaacagtcgaaagattgtgacgcaaagctatagggcctgtaatatggtagccagttgcaaatctgttatatgctgctgatattcagtagtttttttattttaagtggattttgtttacaatacattgtaagcgaaaatgcttgataaaaaagtataacgctaaaaaaatatcaggtattgtgtcaatacagaattgtgtctaatgacaaattaaaataaaaaggcagagaaagcaacattgggtatttataaatataggcatattaaaccaagaggggagaaatgaataaatgaattgcagattttgtggtgcagaagtagaggaaggtgctaaattctgtcaaaaatgtggtaaaaatttagaggaggtttctgataaaaaaaattgcccgaaatgcggttcggaactggaaaaagatgcgaagttctgtttgaaatgtggctatagtatggaaaaaaaagcagcgggcaatggaaaaaagaaacttattattgggatagtcgctttaattgctgttatatgtattggcggtggtattggcgttgtagttcatcagaaggcagtcgaaaaggaaagatatgaacaggagttagctgctgaacgagaacgtcaggaggctgaacgtgcacgtcaggagttgataaatgcgtatggagctaaagcaatggaattgaataatgcgattaatggtaccgaaaataattttaatttactcagttccatgtatgatacttcaacaggtattaatacagggttgcttggacctgattttttcacggactatgtcgaaggactatgctcctctgaaatcaatacggaaaaagacagaaagagagagattgataaaatatatacggaacttcaggatattggatgtgatgaggaagaagttaaggaactgaaaaaagccatggaagactattattatgcatattgtgagagatatagtttccttgtggaaggggatttttcagttaataattttaaagcaaaagaagaaacaagcaaaaaagattttacagataaagcggctgtagttaaaagtttaattcgtaatgtgaatactttgggaacaacggaagagagtgagatagaggagggatcgactttatgatctgtcccaaatgccaaaatgaaatacctgacgaaagtatcttttgccctaactgcggatatcaattaggagaatctgatttcacaaatactatttctaaagggaaaatatcccttaatatcctcttttctatcattggaatcatatgtgctgtaataataattgttatattaattgccgtaaattctacaccagcagcgaaatataataaggccgaagatgcattcgctgccggtaactatgaaagggctattaagtattatacggcagccggcgattatgaggatgctcaggaaaaattggcggaagcaaccattgcagatcattatgcgaaaggtattgaatttttcgggaaagaagaatacgatgaggccttagcacaatttaaaaatgctgcaggttatgagaattccgacgagatgattaaaaaatgtaactatgcgaggggaaatctgtatttggaagcaggtgatctgctatctgcagcagaagagtttaaagcagcgaaaggttatgaagattctaatgaaaagattttggatattgggcgggaatatgtaaagaacaaagattatgaaacagctctgaccgtatttgggtatgttaaaggcggtaaaaatgatgaatacgctcaatatgcgcagggtatgattagttttaataataaaaaatacgcagaagcttcagcatactttgaaaaagctggtactctttttgatgcagaaggactatacgcggaatcagtatataacaatgcaaaatcattcatggattctcaagaatatacatcagcatccaagctttttataaaaatatccgattatcaggattcttctgaaatgtccaatgcctgtattttactttcggcaaaaaagaatatggaggaaggaaatcttaatcaggcaaaaaaggaactgggaacgcttccggataatttctcatataatggcaccaattctgcagatctaattacaaaattaaacagcattagtaattggataggattgtgtggacaatggagttcaacaacaggtttagcggaatcaaattgtaaagcaagaaattattattatgatggaggaacctggacccatgatatcgaaaagggagattataaactggatataaaatgcagattaaatgatgatggttcaatcaacctgtcgggtaatggctccatatttgtctttactaattggtcgacaatacagatcggattaaagtataatattagtaaatcgatttcctttgataaaaaagtcagtgcttctgattttggaactccgttagtgatagacgattatactaccataacactttctgcgaaaggtatcgaattaaaatataaggagacggacaataattccgtaaccagttttatttatacgtatacgactaaggttacctttggaacattgtcaaatacatactgattaaaaatggggggactttttatgtattgtaaaaaatgtgggcagttgttggatgaaaccatataaaacaattaatgcgtacgttggcggcgatgcttataattatattatcaatggtaattatgcaactgcttattttgttttggcagttggattagctttaatttgtatggtatttctaattgtatattatatttcaagggaaaataaataatgatttgtaaaaattgcagtgcacaaattgaggatgattccgttttttgtactcattgtggtgcgaaaataattgttgataaacaaataaatgatgataattcaactataacaaggaaagatgcggaacacgttaaatgtcaaaagtgtagaaatgacttaccacgtggtgcaaaattttgcccgaattgcggagaaaaatcaggtttatcaaaggaaataaaagtactcagtataattggaggcagtttagttgttgtacttgctataattggttttatatttatcaacataaatgctcagaaatcacctattgaaggtgtgtcaaagaaaatctatgagcagggaatgcaatatctcgaggacatgaattctgatgttgttaaagaatatgttgcagaatttatagaaagtaattacgaaatgccgctcgatcaggtggctgataatataacggaggtttcgtttcagcttgatcttgggaaaaaaccttcttccagtgaggtggtatttaatgataccattaatgaaatatggaggaaaacgtgtgttagctatgtacaggaatctttattggaaaaactttcagatgatacagattcgtcttctgtaaatatagctgcaactatcttcaaaggtgttatctatgaacagaaagataaattgaaggatgcggtagattctttaaaagccgcctctacatatgatgatttagtttctgtttataataaggcaagcatgatttatacggattcggagcaagagaataaagaaacgaattagtcatcggctcaagatgtttcgaatacaaattcagcaactgcagaggaaaaaaggccttgaaagagcacatgattatttggattttacagcttattcatataaaagactgatagaacagttggaatatgaagtttttcaacaaaggaagctgtatatgcagccggtaattgtggtgctgattggtttgaacaggctgtaaagagagcaaaattatgtttggattattattcttattcaaaaaccgaattacttgattagcttgaatcttggggaattacgaaagaagaagtggagtacggagtagagattgcttacaaataattgaggagaattacggagatgttctgtacaaagtgtggctgcgaaataaaggaagaaagtgctttttgtcccaaatgtggtaaagtagtaagtgatacagaaaatccacaggatgttagtattactggaaggaaagtgccaagtaagcggacgctccgcttgtttattcccattgctattttgttagtagttgtattaacagtagtagttataatttataatgctatgatgggagtaaaggtaattaataataaagtcgaagctggaagtattgtgcagacgaaagatattataattccgagatcttctaatggtattattcgttttcaaaatgaattagatacaagcaagttaggacagcaggcattacaatatacaattgaaaatggaattttatctatcaacaggcatatagaaattgaggttattgatacaacagcaccagtaatcagtggtcctgagaatattaaggttcaaaagggtgaactatttaatcctgctgatttttattctgttactgattttgatgacggattggaaaatagtattgctgttaccccagaggtgaatatcaatgttgtcggcagcagtaaagtacagctttcagcaaaagattcttctgggaatattgggctcttggatatttcagttcaggttattgatttaacggcggatgaacaactggcgttgaaagcaattaataaatatgttgaaaataatggatctactgatggtgttgcaagtactgttatagtatataaaacagatgcggcaggaacaaatggagtagattattatgtggaaattaacagtgatgttttatatgcaatctatgatgatggagaaatcaaaccatttacagcaaaagaagcacagagtcaattagtattgaagttattgtttatggctgttgagatggatggaacagaagttagctcttcaaaattagttgattaaaagaacggtaaggattgaaaataataaattagtggcagttttgttttaactaaaatggttaccctgggaatgtccgtttgatgggcttcctggggttttttgataaatcattcaaaggataagatattttcttgtgtgataatagaagaataaccttttgataagaagagtataagagatagaatatagcggaaatgtctttttgatgttatgttatatgaaattttattgatatagggtgggtaagaatatgaaaatggaaaaatatgcaggctatcaatatatagaaggcggcgtttgtgccgctcagggttttacggcgaacggattgaactgcggccttaacccggataaagcaaagaatgatctggggatggtatacagtgaaaggctgtgtacggctgctgccgtatataccacgaataaggtaaaaggagctcccgttctggtgacaaagcggcatttgggaatgagcgggggaagagccaaagcggtgattgtcaattcaaagaatgcgaatacctgcaatgcagacggcgtggagatagcggagaaaataagtgaactggcagcgcaggcactggaaatcaggccggaggaagtgataattgcctctacaggtgtcataggccagcctatgtcgccagagccgtttgctgcgcatatgcaggagttggcagcaggcttgtcaagagaagaacatacagccgctgctgctgtcagcacggaaatgctgcagacagcattgagcgacattgtggaaattacctataattgcctgagtatagacggagatacctctaccaatgatatggtcagcattatggcaaacggtgctgcgggaaatccggagatcactatggatggaacagagtatcaaagcttccgacaggcattatatattgtcatggcaaccatgacaaaaatgctggcagcggatggggagggagcaaccagacttttggaatgttcctgtgtcggatgtcctgaccggcagaccgcagtcagtatagcaaaaagtgttgttcagtcatctctggtaaaatgtctattgtttggctgtgatgcgaactgggggcggatcatgtgtgcaattggatatacggatgccgattttgatattgataaagtggatgtagacgttgcttctgcggcaggtaccattgaagtatgcaggggaaatgcggtaatattgccattctctgaagaaaaagcagcagaggttttggcggaggatgagattcatattaatattaatctgcaccagggagaagagcaggcaaaggcatggggctgtgatctgacctatgattatgtaaaaataaatggagactatcgttcctgagttcctgtttgccatatggaaggaatgtccgccggagcggagagggtgagaaaatgaaaatagctacatataatatctggaatgataacaggggctggcccgacagagtggaacagatatgcgatgagattaaaacacagaatgcggatttattatgtctgcaggatgtacccgatgaagatacctgcaagtatatagcggaggaaggaaaatatggattttattcttttgtaaagcacccttcatgtgaattggcaattttaagtaagtatccctttcttgatgattacagctttggtgaagcccagattgtcaatgtgaaagcaggtaattatgtgcttgaagtaatcaatgtccatttaccctgggacagtgtactcagctgtgaaaagcaggtaattgcgctggtgaaccaaaataaaaaaacaaaagcagattactctgttttctgcggagattttaactgcgaggccgggagcagtgtccagaattttctcctcggtaagcagagcctttatggggaggaagccgtaccatattgggaagatctggcaatagtctatcagaatattacaggtatggaaccggaggcaaccttagatctggcatcgaatccccgctggaaggatcatggttataaatcttgtgcaggaaccaggattgattggatactgcttaagtacagttatcctaacccatcccctaagctgaaaacattctgtttatttggcagaaagatatcaccgaaaaccggatattgtcctagtgatcactatggtgttttagcagaactggattttgataatatataaaaaggaaaagggcatctaaggatatctttatcagggaggattatttatgcaccagcttatcaaaccgaaaaaattaaatcccggagataccatagcaacaatatccctttcgggaggccgggcgggtgatcctgatatgatagaaagatatctatttggaaagcggcagttggaagaacacttcggagtacatgtcatagaagcgccccattctctgaaaggaaaggattttttgtatgagaatccaaagttaagagccgatgatctgatttgggcactgacaaatccccggataaaagggatctttgtgaattcaggcggagatgatggcggaagactgctgccttatatagatttcaatattatcaggaacaatcccaaaattctgctgggttattctgatgtatctgtatttcatgccatgtttacccatgcgggagtatcctccttttatggggcaaatctccttgcaacgattgcacagccgggcggccttgatgactatacagaacgatggatcaaaaaagcgctttttttggagaatgtaatgggtgagatagtgccctgtgataaatgggccgatatcgaatgggataaaacaaagaaatccgtctgggttcaaaataccggctatgaacttcttcaggggagcggcatagtcagaggccgcttattgggaggatgctgcggttctctgctgcaaataatgggaacggaaatatttccggataagaagctgtggaaagacagtattttatttctggatatcgggacaccgtatggtgtggaagtggctacccttcatcaaatcagggcctttgcctccgcaggaatattccgacaggccggaggattaatttgtacggggatgcatgaaagtgataaggagattctgttaaaagtgatccggcaagaggaggatttaccggatcttccgattttatataatgcagatattggtcacagaatacccatgacggttattccaatgggggcgctggctgaaattgactgcaataataatacattttccattctggaagcaggggtaagggcataatgccttatctctgcttctgaacgtaccctgtccaataagggttatcttcgtcaaaaagttccgccgcaatttctgcaatttcctcaggctcttcttttgccccggtttcaatccaatacagcagtatattcacaaaacctccaatcacaaaccgggctttgtattcaaagtgcgagggcagatcgttgtgatactgcagataaacagacggaataaactcatttgaggtttgcagcagcaggcccgataaggcgctgcggctttgcagtgaggtaagaaaaggcagatgctttttccagaaaacaaactgtgattccgccatgcttcggatgttccgtttttccagccggttgagaaaggagagatattcttctttcagagctgaaatatggaattccatcacatcctccttatttttgaagttacgataaaaggtgcgcctgtctacctgggctttccggcacagctccgagacggtaatcgattcatatgattttttccctaaaaggcagatcaggctgtcaacaatccttttccgtgatttctgcgccaaagagtgcatgcttcgttccatctgtttatcctccgcaaatgctacagaatgtaaataattgtggctagttttccgaaactgttgtatcgttattttccttatattatactctccctgaatatgtgccacaagtgtggcggaaaggatggaaagaaaacatggaaaatacgtatacactaatcacaggcgcatcctcagggataggaagggcttttgcacttgaatatggaaaaagggggcaaaatcttattattacggcccgttccggtgataaactccaggaactgaaaagagaaatagagaaagataaccaggtttctatcgaatgtattataatggatttagcggcagagggaagtgcaaagctgctgtatgaagaaatcaggaagagaaaacttcatgttgatgtacttataaataacgcaggctttgccacaaaaggactgttccataaaacagattataaaagacagcatgaggaaatgcttctgaacatagtttccttaacggaattaagttatctgctgctggaggatatgtgccaaaaaagacatggaaccgtcattaacattgcatcggcagcctccttcaacccgcttccgtattcggcagtttatgcagccacgaaggcttatgtgctttcttttacacaggccctgagctttgaatatcaggattatggcgtaaagcttctggctgtctgcccgggagcaacagatactcatttctttgatggctttaagactgctgccagtcggctgcgaatgccggaggatgtggtgagaaccacagaaaaagctcttaaaagtggaaagagtatctgtacggacggtattttttgtaaagcgcagatgttattgagccggattgcatcaaggaaatctgcacttgggattatgggaaaaacagggaggaaaacatggggataggtgtgaatttggatgatttgacggatgaaatttcaaggcagctttctgagcaagggaaaaaggatctgctggaagaatttagaaatccgaagaaacgtattcatttggctctatgcagagaaccgtatattcaatatatgataagcggttcaaaaacaatcgagtccaggataacgaaaaaaaaatgtattccgtacgggaaagtggagaaagatgatctggttatcttaaagcagacagggggcccggttcttgctgttttttctgtgaataaagtttacagttatgaaacccgatttttcagtctggacaaaataagaaaaacttatcagaaacagctgtgtatccatgacgactggtgggaacgaaagaaggacgccggatatgccactttgctggaaatcagggagatagccgcgctgaagccaatcagtctgtctttatataaaaacagacagtcctggattatattgagagaacgggaaaagagaatctgagggtcaaagactcttttcccttttcctttattttatattgtaaggttgacatgacatgggaaaaagaatataatcaatgtaatgtttaccttacaggaggatgaaatgaaaaacagaattaggcagcttcgtgaagaaaaagggctcacccaggagcagcttggagagatggtgggaacctcaagacaggctattaacgcaattgaaacggaaaaatccgagccgtccatctggcttgcctatgatatttcccaggtattcggctgtaccatagaagaggttttcttttttgaagaaagtcccagaaagtcaagggctgacagcagcaggagggatacgtatggcaacaagacagcttcgatataatcaggatcctattttaaggaagcggtgcaaagaagtaaaagaggtagatgacagaatcaggctgcttttggatgatatgctggacaccctgcaccacacggaaaatggagccgccctggcggctaaccaggttgggatcctgaaacggctggtagttattgattactatgacaatctgttaaagctggtaaatccgcgaataatggaaagcagcggaacacagatatgcgtggaaggctgcctcagtttcccggatcgctttgtgaaaacaatccggcctcaaaaggttacggtaaaggcattaaatgaatatggagaggaaatcataataaccggagaagatgaaatggcaaaatgcctttgccatgaaataggacacctgaatggtgaaatatttctggataaagccattgaggatgagtcataaaatttttttgataagaatgctttatagctgtacctaaattattacaccgcatcagaaacacaaaatatcttccccgcagtaaaaatcaagtctttgcatatgtcaacaaaacacctgtatcataattataaattctggtgccccaaatgggcggagagtaagattgccttatatctaacaccgcggcagatggcagaatatcatttcatttcggaggttgcagcctgaaaggaagaatgataactaaagcctgctgcctgcgcgggaattaagaaaaggagaggcttttattatgattaaggaaatttggtgtatgcctcacagccatctggatatcggctatacccatccgcagcccatactgatggaactgcaggtggactatttgaatcaggcactggaactgactgaaaaaacaaaggactatccggaaaatgcccagttccgatggaccgttgaagccaattacgtgcttaaggaatggctgaaaacggcagacaacagccagatccggcggatgcaggatgcggtggcccagggaagaatctgccttacggccctgccaatgcataccacaccctgctgtgatgccagggaaatgacaggaatgctcagggatataaaggaattggaggaacaattccatacgaaaatccaaatcgcaatcaatcatgatgtaaatggacagccctggtcaatgggacagcttttgctggacagtgggattgatttctatctcaccggcataaatattcatttcggcggcctgccgttcgaacgcccttatttctttcaatgggaaatggcggatggcagacgactgccgtcttatttgggagagcattactccatgttcagctttttttccgaaacatgggaacactcaacggataaaatgcataagggactggctgaacatgccgcatttctggagaaaaaaggctataacaaagatgtgatgtttctcactgccacaaatcctcctctatatgataataattgcccggatgcagaactgtcggatttgataatgaaatataatgaagagcagcacgaatggaaaatccgtatcattacggctcagacgcttcgtgaaaaatataggaaagagatggaacaggctccggtgcacagaggagactggaccgattattggaattttggttgtgcaagtaccgcaaaagcgacaagagtcagccgcagggccaaaaacaccttacatatgtcggaaactctggaatgctttacaggggcaggcgatgcacactatgagcttgtgaaaaaagaatgctttaaaaatgcaatgatttatgacgagcacacatggggtgcgagccagtccatatctgaaccggattccccggaggtctgttcgcagctgattcataaggaaaaaacggcttaccaggccgcggatctggcaggatatctgctgggaagccagatagaagccctgtgttccaatccgtaccaaagcaatgaggcggaagggatcgttttggtgaatacttcccaggatgagcaggaggtggaagccgcatatcctgtgcagtacaggaaaaaagaaaggcagctgagtgcgctgcgctgtaaaaattatattccatacctggaaaatcgggaagaaatggaaaatggcggaatctggaccatccctccttttaccgccagagtaattccgtttgctcagctggatgaaaaaaagaaggaatgcgaaggtctgcgcggtcagtttcagcgcgaaggaaatatcctgagtacccctttttacaggattgacctgagtgaagaaggaaggattatccagctgtcggaaaaagagaacggaaagccgcttcttgatgagtcacgcggctggtctctgtttgagccggtcagggaaaccattgacgaaacaatggcgccggctgtgcgttctgttctatatggtgacaatataacggacagacatacggatgtatcgcagtggaatcatgactggaaacctgtccattgtatacagaaagtgaaaaactgggaaatcagggaacaggattacagcatttcagtgattacccatggagaacttcccgggctgaaacagataacacagacaattaccttttatgcctatagttcttatatccatgtggaaacgagtttttataaggaaccagtggtaataccggagtctctttattttgcagttcctttgaaaatgcagccggactggaaatgcagttatgatacggcaggtgaggtagtggaactggatgcagggcagctcggaaatgtctgccgggattacctgacagtagatacgggcgtgggaatctatgatgaggaacactgtttgactcttgcctgtcccgatgcaccgatgattcaggtaggtgatttccattttggaaaggaaaacaggagcattgcacgtacggaaaatcccttgctgctggcatggcctctgaataattactggagcacaaattttctggcaaaccagagcgggagtatggcctttacatatgagtgtaattttcataaagagtttacaggacgtatcttgagaaaagatgggatccatggcaaaggatcggtggtgaccggaatagcggtacatgcagaggaagaagcgcgccggctgatatctgtcagcggaagctcgactttacttaatctgtatcccgctatggacaaaaagggaattatacttatccttaaaaatacgtcggaagagacagacttatttcaggttacagggaatgtctttgatattgtttcagcatgtttcgttaatccgcaggaggatgagatatcatcgatagaggtgaacggaaaatgtgcaggtattataatgccgccgggagggctgcgtttggtgaagctttttaccagatgagcagaagaaagacatttttatacgcagtcttaattgtcagtaagcggtaaaaaagcaggcatggttatcatgcctgtttttgcgtgtagggaaaaatttcttatattggttcttcttcataatgaatgggaagtctgaggacttccggttccagtttgtcatggtagatgtcatcgcccccggcttcaacatagacttttcctatttccttaaaggttttcaggccttccggagtgacatatttttgttttgtaaaatccatatgaagcctgtaaagagtggaacggaaggaagaaatggtccgttcgttatctctgtcaatatgtgattcaagcagaacctttatttcttttacatcagtatgagtttccgcttcatactgccgaagcatgtcaatttctgtctgatgctgtttcagagtattttgaatgatagaatctttatcttcaagaccttttctttttctgtaatatttcgtgagaaggccgccgagagtggtgagcagctttgacagacaggaaatcagagtagagagaaaaaagatgacgcctaaaatggtggtgaggtcatacgttttgagggaatttaagattgtatccatataaatgttaaacctttctacagcttgatgtatttatttgaaacatagcctgttttcccatggaattctatatagaaccagttggtaaggagatcctgatggaggatatttacggtgtcgttaacggataagatgaaatcagcttgtccggaaaccggggtacgtctgcagtttaatttgctgcagtttgatacggctccctgggaagaatgaatgtatttataactgcaccagatttcgtcggtgctgctgattttgcaccagttattttggagcagatagatatttactttgtctcccttgtgcatctgatagagtattttaccggatgtggagggagcatttcttatattgagggttgaggctgtgatttcattccacagaaggggggcagggtgggaaggaggcagtgggtctgtgcagtattctttataaagatggtttacatcgatagggttgaccgatccgggaatgtttgctgaaccatattgccatatttcgtatttttcgacagatgggggatttacagaataacgggcacaccagatatcgaattgcttaagctggctgtagttgagcattgtcttgaaccagttgtcggaggcatatacacccgggaaaaagccggcttctttgatgcggctgcaaaatgcaataatatttttggtgcgttgatcttttgtgatattatcggcacggcctgaatgtgactgattggcatattcagaatctatgtagacaggataggtgacagggtagtccttgatttgactgattgtccagtcagcctgctggatggcttctgtttcatttatggattggtcataaaaatagaagccgagcctcatattgttggccagggcctctctggtatgctctgtgaattttttgtcctgaatcaaactgcctgtggtggaggagcgatagcctgcacggatgattatgtctttgaatttggcagcagtaagagagagattgattgtattgtgatgggaaatatcgattaattcgcggagtggagcggaagaggaggattgtgtgggagaatttatttttctggcgttagtatagtcgacgccggttagttcaccgtaataggtaaaggaatttcctcgggcagagtatttggtccggacgagatcgtctgcggtgcttttagcttcgagaatccaggcttcaccggtgtcatcgacttcaatgaggccgatatggccgctgcgccagatgagcattccatttacaaggtggctgggatcggaggttgggtatagatgaatcatttgggattttagctgggagcttccgatgtggggaattccgaaggctttgcatatgaaaccggaacagtcgatcccgatttttccgactttgttgagggtcattgttttgatggagggggtatagacggtggggtacatggaggccagggtgttgatttttgttggggtgattggctcgtatttaaaaccgtatgcgtagacgatgttgttggtgagcatagcggttgcggtggagatggcggttggaatggggtgaggcattgggagggctcctttctttggataataggggaattaagggaaagaaaattagaaaaatgaatggagtgatattttaaatggggatagattttattggatttttcatagaaaacggattaagtagaatatatttgtttaagttaattatatttgtttgagatttatataatgaaatagcgatttaggcggcttctctttcaaagaagaagccgggataaaatatgtgcgaggtgcggattcagtctgggtcccatttagcagcatagcctatattgccaatttcaaaggtaagtatgggacaggcaacaattctgttatatcggctacaccagaagaaatccaaggttacaaacttgcactttacggatttacaaatttatacgcttcaggagcaatgcatgttgctgcaataagtgctgataataatcatgtacaggctggctctcaatacggcagcgttatttctgctacatatggaggctattttgtcaaaaccggaactccttatataatcaaagaacattccctagtaaagacctcaacagtaaatttgagtaataacgttcccggttatcgtcttgtcggaggtgtattacatttctctgattattcttccagtcagactggaggtgctgccataggaaatctggcaatggacaatagctcagatattataatcgctaatgtcttattccagtattctgcagttactgtaagcgctaaacttctatatttgccaggctaaagctatctttaggaaaatataattgatgatatttttacgctaccactcccggtagaattcatatttccatatgaagtaggagcgggacggatggtaactaaactattagaagagatatccagtactaaattagaggttagttttacccagaccccatcatctactttatagaatacgttgctggtatcatatgtatttgtctgagttgtgactactgttccgacggacatagtttcgtattcggctatatcaaacgaaaaatataatgaattggatgatccaattgcgccaccatgagagtcattaaaatcacgttgcacatagaaatttagaccggttaccatgaaaggaaccttacccaatttttttgggactgaatcggcacccacaacatactttccggtattatcttcataaaaggataaccctcctaaatcgctactttgtttattatttatatgataaaactaatgaacttaaaccttaaattaattagtcaattacgattgaactattgaataaagtagcgatttaggagggtgccaatttggatttacattcgatggcctgccaggttacaaaaaggtaggtgctgatacagtttacccttttaaaggatggtattatttaggagaaggatactcatttgatttaaaaagttttactgattattcaaattttacaattgataattttatagttggaagtagttctgcaggtgcaagtcagtctggtgggcatggtgaattcaacacttatgcaaaaataaatgggtttagcctatcgaaatcgtatgataataaattaggaatacttacaataaatggatatagtcagttagctggatgttgggatattgatggttattggcgatatacagtaacacaaaatgttaaatgctttgcttacttaatatataaataatcctttaaagcggacattaatgctcatttaaactgtattgttcccaggcttgtagaattactcccatcataatttccagtagggagattaaaagtaagccttaaataattgtagttcgacaaatcatagtttttattgggtgaaagcactgaatctccaggaagacttgttgttgatgataatgcatataagtattgaaaccatgaattattaatgttcgttgttatcattaatttacactttgagatatcaaacactatggatacaaataccgttttatcataacctataaacttacaataggttgagactgaaactattttttgcataccagaattaaaagggtacgctgtatccgcacctcctggtttatatgtaggtgttccatccgaagcaacagaaaattggaagccgcctaaatcgctatatagattaataatgaaaaagaagtattttattgatttagtataatagtgatgtatattaaatagcgatttaggtggattatctttttttgaagatactaccggaaaatatgtggtaggtgctgattcagttccaaaaaaattgggtagcatacctattaagggtcatcttaaggccggaagaacccgaggtggagcgggattaggcgagataacatatagtagtattccaaatggaagttcaataaaaatttctaatctttcgttaccatatggccctaacaataatattatcttttatgttatggtaaatggagtatccgttcttacagcaaatggtagttacacaataaatactgataatagtaccttggtaatatatatgtacatatatttatctgaagaaggtagtggtggatatggtagttgcgactacgagatttctatttagtcaaaaagtataaaacagaaataaaatatgataatatttccaatttatagctttatttattcaaaaaggtataaatatgtccattggtattatgatatactttaacacaattttatttaacaaatccaatcgatgatactgtacacgccatagtacgagagcctcctccaccctcttgtctaggaccgcaatttggcatctgaacagatagcattatatagaatggtgtgttacctaattctgaaatatctagttcataagtaagagatgacatattggttatagatatattattagtttttagtatgctattaccgtcaatagatgaaagtaatgtaactgtaaatgttcctgtttcagagttaccacttataatcattcttaactttttgtatccatttgctgaataaaatgaattactttttatatgaagttttccataactataccatgtacctcctctgagttggatattcattccggccgtattataatttaatacaccattgtcaagtaagccatttttatcattatccagactcaatgaccaacgtaaaatactgccagcttcaaatattttataatactttgcacctacatataaaccaggttgccaaattccgtttgttaatatctctaaataatctgtttcatcattgtattttgctgttaaatcgctatcttagaaaatataatatttcatataatcaataatttatttgttacagaaatactgtaatatttagtttagatgtttctgaaatatgcattgtatctaggagagcaagaatatataaaagaaaggcttaaactttaaaatgaaaaaggatttgttaataaaatatattgtgattatataataaagtacgtaataaaattataactaattattatttcacaacaaatagacatgaatagaatccatgtcaaaaaatagatatagggtattttagattctaattatgctgcatgtattttacactcagatctaattctttcaatgttactataaatgtaataatcattagtagtatctatgctttcatgccccatcatatctttgagatcctgaatttttacccctttatttatcatagaagtggcaaaccatttcctgaaccgatgaagatgaacatttgttacattagctcttaaaccaatttccttaacatatgcgtggatagaattaactgttagctttccatgtggttgacggtctgaggcaaagagatattctgattcataacctcgcgttcgtagataaaactgcatatgaaccttacatctagaagagaagtatactatgcgttctttggcacctttaccatgtatcattatagacatttgatcaaaatttatatctgataatatgatttttgtcacttcttctctacgaatacctgttgatactaataagtctataagcgcggtttccttaggcgtagtacatgcatcctgcattaatgcaatatcttcatcggtatatggcatttccattttcttttcaattttaaccctttttattcgtctgcatggatttttgataacataatcttcatcttccatccaactgtaaaaggtatttaggttacgtcggacattatcaacataagagttttgatttcctttgctgataagtccgaggtaacatcgaattgcatttgtattaaccttttttaaatccatattgatacaagaggcaaatcgattaatagtatattgatactgaataagggtatttggaaggcaaccttcaattttcttacaagatagaaaattttgaatgagtttatttgtatcatccatatccacagaaggaagatcttttgcttccgaaatatcataacattgcaagacattagataacgtataaataagcatatccaattgttcaaccgttagattttcagacattgtttgtgttactagactaataagcttttcttttgaatcattcatacacatattctcctttttagtgtaatatttaccatcctaataattacaaatatattttattttgtcaattaaatggtttaacgtgtatgaaagtacaaaataatattgtattaaatagcgatttaggggggctatctttttatgaagataacaccggaaagtatgttgtgggtgccgattcagtcccaaaaaaattgggtagcgatctgaaaacacagactaaatctgcaacataccctatggcaggtgtgaacggtgagcagacagttgatttttcggtggtatttgatgggatatctggttataagctggcttatgctggcatccagcaacttaatacttacataagtaatggtacaattaaatatgttgaatttacaagccaacgtatatcaggtaatactgtcacctggtctgtacatacacagaggggaactggtggaggaaataatacctgcgtagtacaaggtatctttattccaacgtaaagtccgcattaatgtaagagcaaataagcgtgtacttctgcatttgatgttgtcctggcattaccacggctttggcatccaatggcatttatatctactgtttgatacgctgataaaattcccgtatttgaattatacgatttatttaaggtaattgtattgtagatatcaaagtaatctgtattgcctcccgtatgacagccctttgaaattttagcaataggctccacaataaaatcagttacggcataattgacatatccgctatactgtgtgacatcaaaatttgtgcctgtacccaaatcaataatatccagtaacttaaaagggattactgtatcagcacctcctggtacaataaagcctggtttaccgtccgttgttttactaaatttatatccccctaaatcgctatttaattcactaaccaacgccgtactagccgcaattttgtcactgttcgattctcgtgaactggagatgccatcgatggcacctaatttgtcctgagccgtctttccgtcatcgaattccagtgtatttgcctttgtccaatgggacacaagctggaatccggacgatgttaatatgtactttttaaattttttataacctgatgcaatactcatattattttcctttcttagtactctttattccagaaaaacttgccttccatttcttctgaggaaggttctgtgtctgaataaacattaaaaatttctcggtttttccctgaaagctgctgctcgataaaaaccagtttctgttctatgaaattgaaaagagaggcactaaatgcctccagttcgggacggtttttgattagatcggcggcaccggccggatttccggctttcagaagcgctttatgctgatccgatatgtcccggttacgcaggcgggcagcgctgcgggggatgtagttaaaatcttcattgttcatggatgcctccgtatttagtattcggcgaaccattcggttcccggtccaaaatcaccttccggttctgtctgatcttctgtaatgactactgattgtgttaaggatgcagtctgccagagatcgtgaaggccctgttcaattttgtttatgctgtccatatctatgatatagggcttcaggagctcgtgattttcttcaagcaggctggaagcgccggcataatcctcctggtccatgtatttataatattgcaggacaaggggggcgactgatgaatctacatctttatagtttgataactgataagccaatatttcacctcctttctatcgtggaatctcataatcataaaggaacggatggaaacggtacatggttatggaggtagtgggaacggtgcctcccagattatgagatatgttttttatgatatattgacagggttccccggtatcctgtttctgccaggtcactttttcaaatacatccagccatgggatgcagagggttgttattgtgacagcatcgttccaggaagaggttttgatattgtcatagatggcgttttctatcgctacggaatcagattgtatattttcatatttatctccggttttgacatcaagtacgatgcctatctgctgaatcgtgaaggggttatccggctccacgcggaatacaatatttttgcagttgtagcgttctgtaaaatactgtttggtatatacaggatcgtccgaggacgccgtaagcacgcatacggcatgaggctgatattggccaagatagtaaaaacggcctgcggaatccacttttttgtacagcagtacataggtttcatctttgtgcatggttccctttgcaattggggtagtggtattctcgtaatagattggaacaggagagaggccgttaatctgtaactgcattccgtccaggctgtcggcattcggaataaaggcgatgtagtcgttggatacatatttatcatattccgtcagctgtaaccggtaggtatttccggacatggtgcattcggtggccattctgtcgatgtcataaacggagccgagaacttctgtaacattccttatattttctatgtcatagtctgcggattctccgctttctgttattactgatttaagaaagctgttatcaagtgtaatcggatcattttcacaggaagggatcccgtggcagcagaagttattgtatacatcgaaatatttctggacatatgggtaaagtccggtgatctcattgatttcatccgcggccatgcagcctatattgaattccagatcatagggaagacggttccagtcgggattatcttcccgatatttttcatagtccgggttatttgactgcataccataaaattccccgatatcatcaattatgtaattctcgattcctccctgctgttttaccacgacagaaaggacatcccggagcgtggatttatttccatcctcgtcctgtaccggaattttgataaggggagagccgcctatttgtccgttccgggtaccgttcagtttggcgaaccaatccgatacggttaaggacagggtgtggcttgtgctgttatattgggtattggaagcggtaatcaggtaagtgccgcagggataccacaaataatcgttgttaagaatgctgtatataccgatttcaaatttgaaatccagtccgaaccagctctgtattttttcttcgatatttgtatggaattcgtccagggtcagtgtaaaattcagtgtgcgccggatatcggattctccgtttatgccataggttcccgcctgggaaaccccgtaaaggacatccacaatctggctgcccttcatgacgctgaaacggtatttgtaatccagggatccctggctgaaaagaagcttgtcttcttcggttattgtatatctcataaatcaccaccattccacgccgacaggacttaagccattggtatataaagatttgggatctctgacatcaccgatttctgcaaactggaaggtgattttccgcagatccttatggccttcttccgtatcggtgggtgtccctacgatttggatcatccagatacggccgtcatcccatttgagaattttgggcgttttatctgtcagatagtcaataaaatcctttctgagctgtatgccgccgggcaggtcagccatgcagtcctgtgtatctgttttgaggaaaacaccggttacggtgccggtatcgtagttataggcgccgttgctgacaaccttggcatattggctgtttaaaaggggaacggcctcaccggaaacagttctggtagtatcgcagccgtcaaggttatagacagttcctatggcattattctggttgaccaggaaaaatccgttaaaatcagagtggacttctctggttatgtagctgttttcaataccgttgcaggtggaggaaagcataaattcataatccgtgtttccgcgtgcataccggtagaagtaaagcattttgaaatcttcaatggtattgatatctttggtatggatggtaatccagtccatacttcccttttcacggcatttcacgatcattacgtcggtatttctcaagctgaagccggagttgccggcatcgaggctgtcgtcgaagggcgcactcagcagagtatcgccgttccattcgttatgggtgctttcgatggtttcctccgagtttttactgacatacagatgatcaaaagtgccgttggtgagttttatttctgtgacaggactgacatgaacggcgggcggatccagggtgtgggagccgctgaaaaatgtggttccaagaaatagcatagtgcgtcagtctcctttcaaatatcttcggttacggtatctgcttcatagtagatgtgtaaatcatagagtccttttttataactaatttcaaatactgtggtatagaggtcctgataatcagtgcctgcaagcatgatcaggttattttccgtatcggcgagcaggaagccctgggtatcggcaagacaggattggggaagctctgcaaaaacatgataagctccaagggttttcccataaggaatatgcaggactccataataagcttttcccagtttttcaatatggatatcaagataatttcctgtctccggacagcgcattttgaaaaaagctgagttcagtggtagttttctggctttgacaaataccttaaattcgtcggttattttaaatccggcattgtaggtcagggtattgtcgctgcctatgatcagttcgctgtttttaatggaatagttgtcattatcgatttcatagccgatatcgatgactccgctttccagagagatactgccgttttcgggatggttttttgcttcgaaaagtacgttggcgggcatgacaaaatactggatattgatttttatatacccggtgtcgacagaaaaaccgtggacagtggttccggtggctcttatatagtattcgctttcatttttcagcccatagaatgtatggctcatatcggcgggatcatatttatggccggaggaagccgccagggatttatcatagtcataaagataaaattgaaaatcctggaggggttcgtgttcactctgaaaataatgaagcgttaatttgggatttgccgtatgaagggtggcagtatcccgcatatcttcaaaataaaattcaggtgtcgtaaaacaatagaagagtacgggagcggaaagggcggattcgttgccgtaagcatcaaaaacctggatccggacctgataggttttcccgggaacgaaggtgccgccgggaaaaacatgatcaagccgcatccggtcctgctcagaatcatatacggtctgataggtatcgttatccagaacgacagcgcggttgcggacggtctggtttccggtataggtaaaggaaacggaatagttatactgaggatcgaaggcataaatgggatgtactaagggagtatttaaaatcgccataatatcctccttagtattcctgaagccagtaattgtttaaggaaagcccggaaggttcggtcttgcttatcgcttcttttaatacgccgccgcttaaggtggcggctatggaaacattaccggagaggttggtggaaacggaaccgctgacatcgccggtcagggaaatggtccggttagcggaaagctttgccgcactggcagccgctccgcccggagtatctgagccggcatagttgtgggtatgggatttggcggcggcatctgtaatgccgtatccggacagggtggtgggattggttccgttggttacgtgtccctgggcatttacggtaacacttttataggttcctgcggttacgccgctgtttgggtggacgtaggaagtattccatttatctaccgattcctgggtgatggtatcgagaacgcctttattggcatgggtatggttctgtcccgaatcaatatcggctgaggtaagatagccggcatcattggtgaactgggacaatttggtgggcatatcgggtatctgggcggtgacatgggtgtgggaggagggcggaaatgcagcgggcttatttttgatataagcgtccgaagaggtatcactcacattccagtccgcctgtacattgacctgtgctccttctgccacatctgcaagcttgtcgagcatggtctgggtaagcttatccagcgtgcctttgttattgtgtacatgctttttgctgctggtgtcgttccattctgtccgttcttcgtttgaaatgtgtctgctgttgtcagccttatggacatttacgctgtcctccagttcttttccggcggaaccttcaaagacagttccggcttcgtttccgaagagaagattgccggcggggagttttgtgttttcatccaggggtgctatgccgtttgcgacgcctatgttctcctggtgtgcataataggtattgatgtcattgtgccatttcagatattggaccagctgtctcagagttcctttccgggtggtatccaaatcttctatgattgtgatgtcagaatcctgaagattctgcgcttcgggtaaatttttcggttttttataagggattgacatatattcacctccatgagtgaggataatctgttacaattttgcaattatcaccttccggttaaaatcgccggaaatgcagtagacaaggcatttatttccgggaacaaaagtaaatgtggttccatttttaatatcgtaacgctgctggttgacgatgacctggcaggtcccgtcaccgttgtctttttgtataaaaccttcatagtcgtatctcgcattgtttaaagtatcggcaattgccctggcgagaacggtaattgccttttcatcgtatttttccataatgtaaaagggtatgcagttcatgcatacccttaattgattaccccctttttgataattcctgtttgatttgggtcggcagccgcatgacgatttgtctggagagtgcgtctgcattctggacattttcaagtatgacatcaccgatactgacattgacgaggctgttccggttatcatttgataagaactgcggtgccgtcggggatgcgaaggaatgatccagaacagtattgcgcagctgcaattcgggcaggggagagagggaattccctatgaataatccgtttgaacgattggcggctgccctgtttttcttcctgattaaagaaagggtctggctgttgttgagaacctggtctccgggacgtaaatctgtcagtgtcggagaggaagtgatttcgtaggttccgtttttatgtataatagtttccaactggttgtattcagataccagtacatttctggcgccgttggaaacgccgccttttgcagcggctaatcctgcggcacttgcaccaggcgctgaaatatttgtgtctgaattcagtgtagggataacggcggcgatatttctcaggttctccaggatattcgaaagcacgccgttcagctcctgccatttctggatctgggcagggattccggtttcctcatccagcgcggccttggattgggcagacattgcttccagaagggagccggaatcttcgccggagccttcctggccttcggatgattttttcttgccggaagaggaacctgcaatggcttctttggctttgtttacgctgcctgcgatgctttgggaggagttatccgaggattcttcgccggcaaaagcatccgcaacgttgttgagcatgggaacactttcgtcttccagacttttaacggcatcaataaaggagacgtttccgctggcggaaccgccgggagaagattttgtacttttatctgttccgactgatacaccggtgcttccgatgacagaacctgtcatcatgcctgcagcggcagcaacgttttcgaattggtcgattacggttgagagcgagtcatccaggtttgcgaagtctataccttcgctcaatttttccatataaccatgggtttcttctaaaaagctgggcagatcagagacatctacgccggcaaggtcggataaggaggagagcatctgagaattaccggaagaaatatcggcaaggatacccagatagtgttcttttactttttcaaaaagctcttcgcttgtcagctgtgagatatcgtccggtgaaatacccatggatatcagctggacattcagttcaagctgttctttgagatcctgaagttcttcccagcgggacttgacgtcctcagcgcctttgatttgtgtgtcccaataggattctgtattggaaatcaattcttcataataggcatcaacctgatctatctgatcatcgattgcactctgctgttcttccagaacttcttttttcttttcaaggagagagatttctttttcaatattggcaatacgaatttgatcctcggcttctttgactgcctgctcctgatctcggatggcaccgctgtcagtttggtagatgaagcctttctctttgccgctgtagacgaattcggtacgctggttgcggagcctttcaagctcgtattgttccttctcaaggtttatggcattttcacgggcttcgttttcttcatttatggcatcgatttgggcctgtttagagtcgatttgcttatcaattagtttgatttgatcttcaatagcatccttttgggcctcgagagctttcttggctgattcctgctgtgatttcagggaatcaacggcggaatctttttgaacattaagggatttgatatgtttatcgatttgtttgacgacaccggagatgacggacttatatagatcgagcatgccgtcgaggtattctttttggtatttgttgtattcatcgatgtatttatcttgccctttgtaatatctttcatacatagcccggagaacatcaaggtattgcttttgactgattttgtcgcggtcgcggatgtctttgagctttttgtattgttcttcgaaggcagtgacgtgggggtcagtatcttctttactggcagtaccggctgatttcacgttatttgaagctgatgtgttaccagtattaacatttacatgaggttttaaattcgcgacatcttgctttagttgttcgctagctcttagtactctttgctcagctctttgtgctgctgcatcgtcacccatttcaatagctctattataatcggcttttgcactttgcagcaaagctaaagaacttgatgtaacaccagcagcttcagccaatctgagaatattatttatatcttcatcactacttattacttttgaattgagcaatgatttttgtaaatagaataatgcaagagcttcagaacaattattggcagcaagctgttcctcaccaaacttagcaatttcggaaccagttgccttagataattcactaccttcttgtgccaaatattgttttgatgcaattaattcttgattcttaaaatttaatgcttcggcaacaagtgcctgagcatttgaaacccccatttcttccaattgtttttctatggaatcagcagtagtttcatttaactgatccataacatcagtactgtaaagataagatgttgctaaatcattaaaggctttctgaacctgttcggaagttgatttactatttgtcagtatggagaaaaaatcttcaagttctgatgtatcaaaagaaatacctaatgattcatcaaggttgctaaaagttgaacgcaaattttccagcatatcattatctatattttctttagtaaatccatctggagtaaaaatcttttgatacgcgtcagaaagagcatcgaactgtggctttagttgagaagatattagtgaaatcgttttagaaattgtacttgcacttgtatcaaaatcagagttgtttaactttgcttcttcgtaaagtttattaatggcatttgaaacatagttaccttcatagtcagcgttgttttctgctttttctttctcttcctccatataattatctaatttgctgaaatcggaatcataggaagatattaacatgaagtttatcggattttgtttggcatattctgttaattcttgattaaccttatcaatttcttcttttgctttattttcagcagcgtagtcatgatcaattatatcattagaacctataaatgatgactgtacataagatgaatcatattttttgtcaattttatcaattagactttgaaactcatgctgttttagcgaaaatatgtagcttatagttgattcatcaataccattatcagctaaagctttaacaaaatcttgatctaatttatcaatactgaaatcgttattaaacgcaagattatttgcgtcagcaattactttatcgtagtcaatatcagtaccttttgtaatagtctttgctagatctaaaaaaacgttgggatctgtaagagactgaaggttataaatcataccggtgtattccttgtataaatcttcatatccttcaactatagaaccatcatcagccttaaatgagttcgttatttctagtaattccgatgttaatgaagctatatctccagaagaaacatcaattaattcttgagtagattgcagcttgtttacatcacctttatcaagtgcattcatatataaattataggaattctttaaatttgacgcttgatatttggcatgctctgcataagtgtgggattcactttgggtcgatatagaattaccatctaaagttgaataagtcatctcagtctctgtatctagtaattcttttgcattatgcgcagcgtttttctgttttagttttatattgttttctaatataattttttgagcttctaattctgaattgagtttagataattgggctatttcatttttgtcagtcaatgtaattttatcttgggatgcaagctctttgatttttcctttgatagaatctagttcaccagtaattgactgtaattcggatttatcatttgtcaaatctgttagagaattatctaaagccttttttgcattatcatgggcttcaactaatgctttctttgcatcttcgtttgctttgtttatgtaagaaatcactccgatggcaacagcaccgacggcagtcagaatagcaccaataggatgagatgtaattaccccccataattttgaaaaacatgcagttaaaacatttgttattccaatatttgtagtctctacagcgcttagaccaaatattgctgccatttgctcggcttctgcggctgttaattttttacttgctaccgcttgctctaacatagataaggtaagctgttgttttatagcaacttggccattttccatagcggtaatacctaatttactcagaatactttctgcgtttgcttttgacattttgtttgtcgctgctatttcaagtatttccgcataagtcaatttatcagttgctgtagtaagtcctgctttcgctatagcaacttcgacataaggagataaagattgttctgtaactaaaatttgccgaatttgctcatctgttgcgcctttgctgactaatgcaaaaacagattgttctgtatttaagcctgctaatgctgtcctatatacatcaatattagcaggatttacacccactgttccaatattgatctcttgtaatgcttttaatgcatttcctaggttgtttagttcacctaatacgttaggaatatcttttaatatcagacttttatattatttttattataacaaaatgctattccttatacattccaatagcaagaatataaaacacgcaataaagacagaataccccagtctctgcctaataatttcactgtattgctcagtgctagtcccgaatgtctgtttaagcagtatcatttcatatactgcttatgaggatgtcattactgtggggattccgctcagatgagacggctttcctgctgaccaaatgaaactcacacatttttacgaacctgaaattgtcaccaataacaggagagtagcagagtattgacatttttcccaggcatagaattattaactatgcgcctattcaggccatatacctcatttaacttaatgtatttcatcaagcgtaatatctaaaacttatctttgataagaaaatttattactgtcggcatattttatgagggtaaacattttaaccctaccgacattttttattcctgcaaacaagccacctgcaagtgccagagaattgataggccccagggcatctgttagtttattaatcatttccaataaggaattcagtgcatttatgccggaaataatggcatctgagtttacgaaattcccgaccgtatctgtccatgtattggacagtctgttgaggcttccttcccagctgtcggcagtactcatagcagcttccatggcgctgccgctgcctccggtgtagtctgtaagcatctgattaaaggtattcatattctcgagaagagcagataattcatttgcctgatcattccctccgatattggcaagtatttcaccttttaaggaatctgtttcacctaattgattataagcatctgacaaatcccggagaattgagatgggatcccgtagctgttctgaaccattgaccatttctgtcatggaaacatggacggcatccaatgtttttacaatttctgaagagtcggtattttgcaaattgctgagtatggaattgacactgttgccgatttcacttcctgtattatgtgtgacggatccgatggttcctatcatggcggatagttcttcaactgagacacgatagccggacgcagcagttccaattgtactcattgcttcagccatattgtttaaggaaatattattatgagtcgcaatattggtttgaccatccagaacttcgtttagtttttttgcttcaccgttaaacttataagcggcattcagagctaatatatagttgtctgctgtttcggcagacatgtttccggctgtttgtgcaagaagagactgttcggccaaatcttttccctgatttccggtatagccggaattagccattttctgtaccttagataaataatcagatgctttttttccataggtactggctgtttcgaatgaggaatctccaagctgcttcaattggttttttgtataattacttgttttcccaatatcagtaagtatggtatcaatacccctcaattcttctatagaatcctttatctgagatataattttttctttaatcctcagattggacaatttactcatggcatttttaaatatatcaccaaaacttttaccagcctgtcctgtaatgagagtttcattttttaagtctgaaagctgatttttcaaagtaataagcgagttggtatcatcaactttatctatttctttctttaatacaatgaattttgccttcagatcatcgctcattttggaattgctgttcatgaactgctcaatgtcagactggacattttttttcttcatatccagttttacagttaccagctgttcatgatatattttatcgaaactgctgttcatttttcggacttgctgttccagggcatttttatcaactgttatgttgagtccgattcggagcatgttttgcagtttcttttgtaaattagccatttgttgtttaagtattttctcagactttgcttcatccaaatttaatgtagtagataagctattgtcatttcccataaacacctcctgtttaggaatacgtatcaagccgcactattccgcggcttccatttcccgaagcttttgggcatcatcgtgtatcttttcgtacattttatccttgaaatcaggggctgccaccatttcttccataaacttcagtacggtatccatgttttctccgctaaggttattctgtaattcagcggtatttccaagataagtgtgaacaagatttacaatttccttcacttcctcagcaatatccgccccattaataataagaagcgtaagagcatccctgcgcagttttctcagcttccaataattctttattcttgttatcataaaatttcctcattttctcatatttatttacagttgccagtctgtgatcaccgaagctgctcaatcgcctgctttaccttatcataacccaccatggcgcccatccagttagcgattcccataagcggaatataagtaatattcagagcggtaaacggtattccggtactgatataataaaggacagtacctccgcagcccacaagcagcgcgataatcagcacaacaatattggacgcataatgaacatgctgttcatccaggaactttttcaccgcttccgtcacgactgccgtcaaaacagcaaatgaagtcaataaaaataaaaaagtagttatgttcataaattcactcccatccggcggaacgattgccgcctctgtccgctgcattttttgcctgtccggtatcaggcctgttttccagccagtatttccaggcaaccttggtttccgggataaaataataggcgatcagtttgccgccatagccttcatcgatccagacaggctggactccgagtttggcataagttatgatctgtttgatattgcagatcttgcataaattcgtttttccatatacttcggttacatcttcaaaggttttgtatttgatgttgtccatctccttttcgtaaaaaatagggatacttgaaccacaaaaaatattgtgaatccaggtatccctgtcgcggctgtccggctcttcccgattccgtattttcttccccggaataaatccggaaatcctgaaaaaatggaactgggaaaagtcggacagccgccgctgtcaatccacaatatgaataataaatccaaagccggagcatggctgtaagccgctccggtttcggaaaagcaggacgggagacaggctcccgccatttggacagattattctgcttcgtcagaaagctccacgaattctgcaaagttgccgtccttgtcctccagaagatcgaaggtcatggtaatgctggcaggatcaccggcagaagactgggaaagggagaagtttctctgaggctgagccttgtagaagatcatcttataaggagtcagtacctcgttgtcatccttttcaacggtatccatggtaatgtagtaagccttcggcagcttgctgttgttgatggtaatgcgctttacgccgcttgcttttgtaacaacatagcctacttcatattcaaggccggttttgatatcttctgcgttagcagctgtgaacttgttgtctgcaaaggcaccttcgatttccgctccggcaaaatcacctgctttatatacgaaaacgctgccgggcatcgcattgtccggaaccttcaggctgccgtccgcgtctgctttgactgtggctctttccggatatgccgcatcagtctcgatcactcctccggagatcagggagtacagttcaaacggataaacctgtgcttcgatggtaatggttccttcgatgggattcgcaaaagcgatccttttcacgccttttgccgttgcatacacggattccccggtgagggcctgcgtagttgtattggcagtttcgaagaagagtacgggttttctgtcaagggaacgaatatctacatcacaaacctgtctgttagctttattaatattgggcataataatcctccttaaatttataaaatagcagtccgtcttttcggcgggctatggttactgtttgatacaatcaaaccattgtgtgaaatcgaccttattgtccttgtttccccatgccgcgacagacattttaagtacgtcaaaaatggtgttttgctgcatgcgtgcgaacaggtcatatacctggtaaactgtcagatcccagatgttcagaatattgatggagctgtgataagccgcaacggctgaaataatgtttggcagttccagtttgggatcacttttggcttttttttcgttgcctttttttcttttattcagtttttctataattttggccgccgctttgtttttggcattagaggtatccatagcatcttttgatacggcattcagctgtaaaataatactctcgatttcgggaagcagctgcggggtgattgcaccggtgggcgtatctgtttccttttcataaaccataaaggcatggttttcctgtgaaaaagacagcgcttcacataagaaaaaggagagtgcctggttcagctgttcaatgatttgggagtcaaagctgaagatatccagtgcctgaatatgtgccttgtcctgctccggcatctgttcatattcgtcacggattttcaggataagttgtttttcagattccggatagccggcaaaataattatctcccagttcttccaaatttttatagtaggaatcgatatcaagaagcagcatggacaaatacatattgtaggtgctgaatttattgggcagggaatcgatttccctgagagtgggagagcgtacgctgcacagattcagcttgagtgcagacgggcttatcaaaatactgtaatcaaggttcaagatgcattaccccttcgttttaaaatcaggtacggtgaagaccatctgtctgccgtagaagcggctgtccagcacgctgctggttacggattccaggcgcagctgtccgatgccgaactggctggaagcatgcagctttctttcaatcatatcggcaaggatatcgggccgtgtgccgagaaatccatccttttcatatggcatctgatcaaaaggggagtaggcccatgcggttattctcatatcctttatcatgccggtgggtatctgagggacatcaacttcgaaacaaaggcaggttttggtttctgcctgtgtatttatatagagataagggaaaatctgactgtacgggaggccgtttgcttcggcttccgtaaaatcctccttattgagcaaaagcccgcagatatcggaatcttcagtcagcatggaaagcagtctggttttatataaaccgatatcgtttacgatagattttttcataagctttaatggtatcctttactgaatttactgacaggaacagatggtgactgagcggcggtactgcgagagcaggttttccgcgttttcggattctgtcatataataggtacgtctgtggcgtgcaaccgtgtggtggatatcacctccgggaccctggcatacgccgtttgccgccagataatttttttccttgcgggaaattcttataatggtaaggaccttctttcttctgtattttccggaaaaggaggggccggcggcgatactgtcagaacaacagcaccgccgccggttaagatgtgaagaggatagtacggctgtatgggagaactgcagccggaatatatgtaagcttaaaagccggcaataagtgatgggcatcggggatattcattgacatttccatttttctgcgcagtgggaaatggtttgagagtctgttactctctcataataaacacgctgtgaaaggcttgggaacgcagaaaaaacggtaaaaatcgaacatttgttccgtatttttgttttttaaataaaatttgacagaaaagcctccttattttgacggtataaggtgttaagcatccgccttccatattttatgctgtatttctttttgcagtgggggttattgttttcttctgaaacgtccagcgcaatttctatcagcctgtttatggttttcatgttgccgattttaatctttttaatagaagagatgaattcgtttgtcacttcgtcaaattcggagataaagtcttcttcttcgaaacggtcatgattccgtttaataaagctgtcataatcggaaacaagtttctggattttactgatctgccggtcattcgccttgccgtccaaatggcggatgaattgtttggtcgggatcgtgctttcctggctggcgctctggatcttgtccagccaatcctgaagccagttcatgggacagaccagcttcggattgatcctgtcgttgattttcgcttttttatcccggatttcttcataagggacatccttgcccttttgggaaacggaaatattttttacatatttaataaagaaaggatagtcttttttctcgtcatgaagcgtggggttcatgcagggcatttttttaatgcgttcgatttccgacagggcgtccacttcatattctcttttgcagccgtcaatgatgacctgggcgaggacggacaggatcacgaagttgtcatataattcccggctgggggaggtccagtagtaggtgagggccagctgggccagattgctggattccccgataccgcgccgggacagggcgaatttgttatccatccgggcgtattcaaggggtgttttgcgataggttactccgctttccttcaggcggtttacgatggtggaaaatttttcgtagcagatccccgcatatttgacaaaggtgggatgatcggtcacgaagaaaaaatccgaatcgtgatccaggccgttgcctctgtcctgaatatcggtgccgatacagtttacgacgatgatattgttgctgaaaggaaagtaggcctccatttccgggctgtaatgattgtgaaggtaacagatattgttgggggagttgtggggggaacggaaagcgcaaaggaattccccgtcaccaaaacggcttgtatagcactggatggtgccgtcttcatgcagcagggtgggatcctttttccagtcgccgccggccgcatacagaagaagggcatagggattgctgcaaatagtcaggttgtccccgttgaccataattttcccgcttcttaatttattgacatatgtccgtatgatctgccttttttcataccggtaccatttactgtctgcaaaagcagggttctttcggtataaatcggccatcatttcatagtggttgacctcgttggcattttttctgagaaatttttcaaactcctgatcgtcggatttcagtaattccacataatttacgctgtaagcggcgatatccttcacgtcatctttggtgcaggggagggtgttgagcatctggtagctcatctgctggacatctcccagcttgctttcatgatcggttttaacgattccgaagcaggaaccgtcggcattaacctttctgcaccagtaaagataagcttcttccggagtatttcccatcagctccatgaatttgatccatttgacggcattgtgagtggtaataagcttgatgtcctttgcattgtgccattggccgaacatatcctgtatgcgccaggtattgtaatcaaggccgttatccctgcaccagtcctgcataaatttttgaatggagcatttaaaggcacaggctttaaaaaaatgattccgaagcagcgccataccgttgacccattccggaagacaggaggcttccataagccccataccgtcccacatggtatttttgacatctgtttgctcacaggcgacgacacatttctttttgagggaagggacttttttgaataccttattgtatacaggatttccctgcaaatccaggttacctttatccagagcacgctgcctggctttttccgtggcggcctcgtccacgcagcgttcgaagccctcgtaatcctcggctttgacaacgttggccatagttgtgaagaagctgtcctgatccttcagaatcagaatgtcttctgccgggatgaaaagtgtatccaggattgtgcttgtcgtgagtggggcataggcggacagctccacaattttggcattttccacgggcattttttcgccgaggcccatggtcagccagtcatatgcggcgtcatacaatttttcattcaggaacatgacctggcccagcttggcttttgaactgttccggtagagcattcgatagtgtatggtttcttcctttataatatttccctgccgatccttagtgggataggtaactgaaaccccttcctggtaaaaaagctcccttatttcttccttgctctttttcacgtattcatatttattctgttccactttttccataatgcggcggatgttttcccgggcggcctcatcatcggccttatttaacagatcggtcaaatgcttctgttcttcttcgtaggaacgggaaccgaagtcaaaatcaaggcagatgatatcctttgtactttggcctttcgttactttcattccgtttttctgaagaaaaatgcggaacagactgtggttaaatacgccggttgtgtagtcgtaacggtcccggatgcccagattgtaaccatacagagtaccggcttttatattcagaattttaattcctgtttcgttcatttaagtttctcccttccttattaaaaatggcagtgcaggttaatcatgcggtgatcctgaaaatcacttctcattcgtgcagggcagttcggttcgtttttcccggtacaattgcagggaacgggctatcctgtcggtgatgtgggaagaaggatattcggtgctgaaatccggtgggcagatgctgccggcgtattgccggtggaattcttcccgtgtggggacggggggattgttatttgcgggaagataagtgttcatgttgttctttatataattttgcttaatttgtatttttatttgagtcattgttctgcctcctgttgtgaaatttgagtaacattagtgggaatatactctatttctccattcggggaaaaaacgggtggttcacagccagggagattatggcctctcgtttgggagcatcgggagcggatattatttctcattccgcctgtacctggtcagggagcggtttgaaaaatacccggacggaaggagaaagctgcatggaaaagaacagtcgagtccggttaatgggacatgggatatagtaagatatggaatataaaggaagaaaaagagttgaaaaaacagaacgtatgttcgaataaatattgacaagaacatacgttcgatatatactcaagctatcaaagggaacaaaaaaagaccaatcctcaaacggtgttggcgcacctcggattggtcttaagcacatattacataagcccttgccctaaagcagtaggtttatgaagtacagcagaagctatacatctgcattattacataacaattgttgtatagtcaagcacttctgcaaaattcccttttactataaattaacgttcggctgtgaaatgaaaacagccaaacgtcagctttacatacccctgttcggaggcagtactgaaaggccggattccgtcattatccgaagccttttcttaagtttacgcttatccggcaacaggcattgaaatggaacaatagtttataaggatttatttcggaggtgaattcatggataatacgcctttattaaaggagtactatgcacaaaatgcgaagaagataagaaacatggtagataaaatcctgtccggcttcggcggagtgacacagaaggattatgatgatttttattccctggcgaatgaggtttttgtggacgtgctgcgaagatatgacaggaaacagaggtttgattcctttctctacagctgtctgtccaatcggataaaaacagaagtcacacgcagaaacagggaaaaacggaaggcggatctcaactctgtttcacttgatacgcccataggagagggggatacggtgctcggagatgtcctggtatcggattttcatatagaaaaggaagcggataaagagaaatctgttttttcggaggaaaggatggctgcctattttaacgcattatcagatacccagcgtcagattgttgaactgaaaatggacggatttacgaagccgcaaattatagaaagactgcgcattacggaaaacagttataagataaatctggagaaactgaggaatttcgacaaggttcagctcttgtttcgggggaaaaagaaggataagaaatgtgtggaggaggaaattaatatgagtcagatattaacgcagacagcagaaaaaagtaaaccgaaaaattaccaggtatatgccatcatacagagaatgtatgactattccatccgtttggatcatccgctgcagcgagaatccgaacaatggagcaatgtgatgagggggaacctcatatcggatatcctccaggataacccgattcctccgctggtctttgcagaacaggtgatagacggagtggtgattatctgggccattgacgggaaacagcgctgttccaacgtggaaagcttccgcagaaatggctttcggatcagcaaaaatatagagaggtacctgatcaaataccagacggcggcggaaaccgaggacggaaaaattcttctggatgagaatgggcttccccgatatgaggtgaaggaatgcgatatcagagggaaatgctattcggatctgccggaaaaactgcagcggagcttcaacgagtataattttgaagtgacacagtatctcaactgcagcaatgaggatatcgaataccatataagaaggtataatgcctccaaacccatgtcggttgcccagaagggaattacccatctgggagagcagtatgcccgtattgcaaaggcaattgcggagaagcatttcttcaaggataaagggaattacagggtttcggagtttaccaacgggacaatggaccgggtgattaccgaaagtgtgatggctatcaatttcccggaagactggaagaaaaagaatgaggatatctgtacatatctgaaggaaaacgcaagaataatccactttaatacatttgaagaatatatagacaggcttgacgaggtgataacaccggatgtatcggatatgttcaattccagagattccttcctgtggttcggattattccaccgttttgcccgtctgggaatggatgatgaaagatttgtctgctttatgcaggaatttaaaaacagtctgcacagcagaaaagtatcgggagtatcctatgatgatttaaaggaaaaatccacaaaggataaaaatattgtaatccgtaagcttaacctgcttgagacactgatggatgaattcctgcatattaagaagaaggaaactgttgaaaaattcgatattaccagcgaaaaactgcagcagtttgtggacgagttcaatgaaagcgatattgtaaagatgatccgggtacggcctgaaagagaaaaaataaagatagcggttcagtctctcatggtggtttccggaaaaacacagctttccgacaaggcagtcagggaatatatcgaaagcaattcttttgaggatgatgttatttatgataccctcttgtatcttggcgcgctgaacgactggacgctgaatgtgaataataattccaggctttttgaacagggaaatcttccggctttggtgggagtggtggcctatgcttacagaaatgatattgatgacagtatctgtgttgaatggctggaaaggtatgtggaaaattatgataccgggcacaaaaccccggaagatggcaggaagaagcttacggatataatcacggatttaaaacattttgtttcctataaaaggcacagaacggcatagctgttctgtccttctaaaaggaactgtctgccgtaattttgttttcattgctttttttaccgggggatagtaccatataactaatacgtaatgtgggggacagaatgagtaacagaataaaatggaccggatatttgtatatgagcctgctcagtttttcagcctttcttttagaatatgtctcgatttttgtcattgaaggcttctttctgcatgtggatatatggaattatacaccataccagagaagcattcactgcattatcatggcagttctatgggcggcagtcatcgggagtatcttacttttttcccgcaggcgctatgattttcctgtaaagaatctcgatacggaaaaaatttcttcccgagactggattgctgcttttctctgtctcgccgcctgtaaggttatgacctttatagactggcatacatggaagataatcggagaggcgaagggaaaaagtgtattttcttttctgacccaatatctttactatatattcgaggtggggcttgtcctactaattatcatgttcgggcaaaaagccgcggaaaccggactgaaaagagaaagcaggattccttttggaggtattatcctggcattaacctggggagtttttcattttgtttcaaggggagtcggcctggaaatatggaatgggatttcctgcatgctgttttcggttttgggaggaatcatgtatcttaagatgcggaaaagatgtctttacagttatttgctgctcgctgttggttacctgctttagttaaggcagcatttaataagaggttaatgaaatgtatttatatcattttttcgataaatctacagggccattccaaaatatatcagatttgtctgttgatgatgcaaaggccgtacttaacggaataaagcagacaaagccgaattcccaatgtgctcaaaggcatgataaatatgttgaatacaggcgtaattgtgaaaatataatccgttctgagtttataaaaaagggcggaaagatatccagaactgtgccgcattacatggtggttgaattcagtccatggctgagcacatggtatgaaaacagtgaatatataaaaattcctgttgaagaatttgatatgaatacactttcttttacctatggcgattccatgcctacattcagccctacaattaatgacggcagagaatatcgtcatcagctttatacttataaggaaatcctgaaaatcatcgataaatatggcctgccgcaggattggaatgacgatgggaaatatggcccggaaagatacattgaggtgcatgtgtggagcgatgaaacagttggtaaatacagacactgcccagtttgaaaaagagtgagggaaaaaaagtggaagaagtaagagagtacgggaaaaagtcacagccgaaaatcagatattctcaatttgatgccgaagatatccgtaaggaactgctggaacgctacgggatggaaatgccggtggagtgcaggctgttcgattatggaatgaacgatatatacagaataaaaacaaagaaagagacttattttctgcgtatatcattagccggacttcatacaaaaaaggattatgaagaagaaatgcacatccttaatatactgattcaaaatgggattaaggcggctgcgccggttaagatgagaggcatgccgggacggcaggaggattatgtctgggagctgcatgcgccggaaggaattcgttatgccatgctgtttacggaggcacctaacagcccgtcggatgataaagagagtagcgcctgtaatttggggagcatgcttgccgggatacacaatatatccgatagggagaagtttcaggtatccaggccgcccattgatatgtgccagttggtggaaaaaccgctctcgaatatcaggccttttctggcagacagggaacaggatttttctttcctgaaagagagtgcagaaaaactggcaggatatataaagggaaaactgccggaaactgcgcctgtttatggattctgccatggtgatgttcacagcggcaatgtattttttgcaggagataagcctaccttattcgattttgactgtatgggttatggatggagatcatatgacatctgcgtctatgcgtggaatgaaacatttcttgatgaaaactatatagaaggcagtgtctggaaaaaatatctggaaggctatgaatccgtcagaccgctttccgcagaagaaaaggaaaccatcccggcattcgctgctttgcggcagctgtggttaatggggcttcatgcggatgttatggacagaaatgccggatgctgctggtatcaggatgattatttcgatagtcagataaaaatgttccgtctgtggctcgacagatgcagtttataaaggaaaaattctgggagataggtaaattgaatacaataaaccacaaaggaacggtaacgatagaaaccgggcgtcttatactgcgtcaatttacagaggaagatttggagccaatctttaataattgctggagtgataaagaggtctggaaatggactaactataagccaatgaacagcgtgtcagatgtcatatattcagcgggaatgtttactgagggatggtttggagcatatgacaggcttaatcgttacagctgggcgatccaggttaaggattcaggaacagcagtgggcaggttattcggaatgcatccggatgatcatataaatcaggtggagctggcttatgaactgggacgcagctggtggaatcagggaattatgaccgaggctgtgaatgcagtgatttcgttcttttttagagaagtaggttttaatcggatttatgcatatcatgccgataaaaatccggcatcaggcagggtcatgcagaaatgcggaatgatttatgaaggtactctgcgtcaggcctgcatttgcaacaatggcatatttgataaggtttgttatgcaattctttctggggattattttaatggatcagagaaatagacagtaaaggaaatggaaaaaactattatttcccaaaggaaggagacgacttaaaaatggaacggaaagaattgctggaaaatatcgcgccctgttctctgatgtgttatacctgcggcggttatgaaaaaggtgccatatgcaagctggccggagaattatcaggctatctggaaggcatatatgaattttatgagaagcattccggcccggggcaaaaagcgtatttggaacggtttcaaatatttcaggaagagcttacaaggatgggtgaagcgggatgtgggggctgccggaacggtgaacataacggatgcagtatccgcggctgtttccttttggaatgtgtgaaggagcatgaagtggacttttgcggtgagtgccctgagttcccctgtgataaagtacatagtatctttgaggaagaggtttatttacagtggctggaaggcggtaaaaggatacgcgaagcaggcgcagaacaattctgggaggaacgccggcatgttcctcattatgcaggatataagaagggattagaggaatagcagaagcacgaaacagataaaaataatccggtgaggtgttgaacgattatgccccagaacaaggaaaatctttctgccaacgatgcatggaaggcaataattgaaaaatatcatattttggagcacatcgagaaagatggatgctttcctattaaggccagccaaatcaaggaattcagagagccccggcttatggcaaagtgggacagtacggatgcgcttcccgaggtgctccgcaaaaataagatcaacattctgccggacagccgcagttcctatgtattgggggactttcttctgtatcaggagattccgccgcttgacgaaccggttacaaggatggagcatgtggagcttcctgattatgaatccattgacataaataatatcagttcggaagccaatgcaatcaatgtgttgattatttccgggatattaaatgattttctgggaaccggtgaaaacgtatccaccttcaacggaaggatgggaaccggatgttttacctttgaagtggatacccacagaggaatcaagcaaaaaatctgtgtgaataatgcacagtgcgaaattgacggcggttttgaaaatgaagcctccgtggtcattatggaagctaaaaatgtagtacatgaggattttcatataagacagctgtattatccttaccgcctgtggaaggataaagtgaagaagccgatcaggctgatattttccgtatattccaaccggatataccgcctgtttgagtaccgttttaaaataccggaggattattcttccattgaattggttaaatccaaaaattattctctgcaggatacgaagattaccaaagaagatttgtgggaggtcaggaatcatacaacgatccgcacggatgatgatatgaatgatacggatattccgttcatccaggccaattccatggacaggattatctcccttttggaaaatctgtatgaaaatccgatgacagggcttcaaatcgcggaactcatggattttgaaccccgtcagtccgattattactttaatgcgggaagataccttggcctgtttgagaagcatgcggatgataaacaaaggatagtttccctgactccactgggtgagaaggttttccgactgaattataagaaacgccagctgaagctggtggaactgattctggaacatgaaatattcggcgcattttttgattctatgatgctcacaggacagctgcctgataaaaataaaattgcagatgaaatgagaaggcttcatgtctgcaatgaaagccagattgtccgcagggccggttccgtttcaggctggctgaaatggatgaataatcttacaaatctgtaaagctctgtgcggatgaaaggtaacagaatgaaaacagcaaaccttgtagttgtattggataaagagaacaaatctgtactgttatgtaaaagaaggaaaaatccttataaaggcctgcttaattttgtgggaggaaagctggaaccggatgaagacagcgcagccgccgcatacagggaattgagagaggaaacaggggtaacagatgccgatatctcccttacacatttgatggatcttacctatttcacatgggatctcaagctggaagtgtttttcggatggctaaacaaaagtgtgagtttaaaggaagaggtaaacgaactgctttgggtggacaaggaacaaaactactttgatatgagccattttgcgggagaaggaaatatggggcatatcatggaacagataaagcagtatgaggaggagcaggctttttcccattagagaaaaaacctgcccgtttttcatctatgcaagcgtgggaaaatgagcatgcatttccgggacattcgggttgacagccgtataggtcactgtggtaaacatgccgccgagtgtaggaactccattgttggtaacgtggtggggcatatggcagtgcatgggccagactccgggattattggctctgaattcaatatcccaggtctcacctgatgctacaagtatggtatttttacagatctgcgaatgggatgagataggaaaaccatccgcacctgatacccggaactggtggccgtgcagatgtatgggatggtggtgcatctggatattgccgaaacgtaccctaaccaaatcgccgcagtccacatacagaggaagggtttgagggtatgcttttccgtttatggtaaagaaattaaacatgggttttacaaaggtaagcggataggtccccggtgtgagatccccccagggaagctcgtttacagcccattcctgcagaagacagagataatccttatcaggaccggggcattgcgtacagggattttctacaatcagaccgcccaagagaccggcattatcctggataggaacttctacatgggaatgatacatataagttccgggaggattgcagatcgtaaacgaataatcaaaatattcaccgggattaatatagggagaaggttccagaggcggtacgccgtccatattgttaggaacctcaaggccatgccagtgaacactggtacggtggggaagatgattgatgacacggatcgtgaccttgtctccgggatatacatgaatggtagggccgggtgtcgaaccgttatacccccaggcccgtacaataataccgtctaccagttcccacaaaacctcctccgcagtcagttcaaagaattttctcccatttgccaaagtacagggcagatccggaataccgggtgtaattaccataaatatttcatccttacagattggtgttgctacaatatattttagtttccgcaaaatatgatttttttacaggagttatctttatatggcttatctcatttttgtttcagaaataagtcagtggaaggcacgggagtgaacctgctgtaaaataaaggtgacccctgcaggaggaaaataatgcgcagaaaatacaaggccgatgcaaagaaaagattctcttatttggtaacagcgcttttgattggatttgccatgggattgctggcgaaattggtggataatcccagagtaaccggtatagttcccgtgtttgatgatctgggaggaaggctcggaatatggatatttacagcaactctgctggcagtcttctgtaattctcccggaatggcggcgatccgcacttttatctattttatgtcttttctttttacttattatgcatacacagttcttttcctgggcttttttccaaaaagccagatccttttctggggactatgtgcgcttgtatctccgctctgtgcattcctcatatggtttgcccgtggaaagggatggttttccaatttcctgatttcgctgcccattgccgtgcttgctgcagaggtttacatgacgggaaaggggaattcagtgctgcagattatttatttctgcatgtgtctttgcttattattggtactccccaaaaagagaatacagtgtgccccggtgctgctaattacattcctggtattttttgtcctgataaagctcgatatactgacaattgtatttggaaactggatgttgtagaaagaagaaaggcaaaaggaaaaaacgatgaacgataaaacgataagtaaggaagcgccggaaaacatattgcaatgctggaatctgtcaggaacagcagaacagatttattcaacggcctggcaagtcaatgataaatatgtcctgaaacggtacgaggatttggaaaccctgaaaaagaatgcggagatgcttactgtcctgcatgaaatgggaattcccgtagcagagatcataccggttccgtcaggggacccttatgcatgctgtgatgaaagatactacatgctttcaaagaagcttccgggaaataacgagactgatataatacaggagggcatcgcggaaaaaatgggagagattctgggacgcctgcatctggcattccggaaatgtgaggagcgcctggaattatgggataacagcctgctggatgaaatgaatggctgggttgccgaaagcctgacccgggaaaaatggctggatgaagaaaccttccgcagtgctgtcggtaatctgcaggatggatatgacaggcttccgcgccagttgattcacagagatgtccactttggtaattttttattcgatcatggtgaattttcgggctatattgatttcgatctgagccagaaaaatattcgtatttttgatatctgctatttcctgacaggacttctttcctcacaaatcggaagcagcctggatacggaggaatggctgcggattgtgaaggatgcggcagcaggctatgaaaagtggattcctttactccctgaagaaaaaagggcgttcccttatgtgatggagaatattgaacttctatttgccgcttatttcaatctgcctgagcaggctgatttccggaataatgcgcttaagatgttttattttgtccgcggacaggaagctcagattcataaaatgctggaagaataaaatcgtgcaggaggaagaaaaatggcgggagtggcaaggctttccaccatgagaattatcaatgttttagttgataaaacaggagtgctggaagctatgaaggaggaattgacggaatatcctgagcggctgcgtaaagcggttttggatgccagctatccttatatatgggatgaggagaatgtagggcgtgctgtccttcgtaaggatattgtgtttaatcatcatgtgttccaacactcactggatttattcttatagacgctgtatgcattgaataaagtttattttccgagctggaagcggacagagcagtatattcattcctttcccctcaaacccagagactgttacagcagaatgcagaaggcgattgccctttcagtctgtgcggaaacaatagaggaatcatatgcaatatggcgggaactggtagaggaactgaaggaaattgtggaggaaaaggagataaataatcagtgaaaaaaggtatttatgatgtaggaggagaaaaattatcaaattctgcttttttaaaggctaaagaatttatatataggtacggaagaaaaatcgacatcgcgtggtttgagtacaatttcgtaaataattctacggatgaatttatgaaggtgttgaaaaaataccaatttgaaaatggcggttttggaggacttgttacagagtttgaatatagtgggccatgtttaaaaagcacggaacatgcatttcgctatatttataatttaaaagaaaagccggattcaggaagtccgataatacagaatatgatgaaatatgttttagaacgatacaagccggagatgggatgttggggaaacttacttgtaccggaagtaaatgaaatgcttcatgtctggtggtgggaatataaaaaatgcgatattgaatatttagattttgatagtaaagtaaaggcctataatccaaatggacaggctgcattggcggcttttacagcattatatagtgatttgattcccttggaaaaatatcaggaaataataagctgtcctgtggaaaaagttttgagatactttgataagaattctcctttttactgtgaggtatcatcggatccttcattcaaagaagattatatggttccttataatatgaaatgttatcagcaatttattgattgtttacaatcggacagcaatcggtacagagatcaggagttagttgaaaggttaaagcagattttgagtagagatccttctgtatgtatggagttggacgaatcgctttggacagaaggttaccatgagattccgtgtgatatagtcactaggccggacagttttttgtatcctttggttagatctgaagtagatagtgcattggattatttaattcgtcatcaaagtgaagacggtgcatggcatttatcttatcaatttggagaacaagagggatttcgtaaattagaaaggcagtacgaggccaacataacagccttgtatttggcagaattaaaaagttttggcaggattgtgggttgtgtataaaattatatcttgtttttaactgctgatatacatataatacctcacaataacattaccataccattttataaacgttagatgattattaccaacaggtttcatacataaaattataaaaaggaaaacaccatgtcagcagtcaccgttaccggccagtttaccggtattatcaatttcgccatgcagcgcagccacattccggttatccgctctcttaccataacgaactgttcgtccagaacattgtatcagctgcgtctggaaatttcgatgacgtctcctgtcatggagcactgggagcagcggctgcctgttctggaatcgggaaaatccattgaaatcagtcctgtgcctctggcagtacaggaggaattcctgtacagtatggaagacaggagcgaagggctgctgcaggtaaaggtttacgagggagaagaaactatctatgagtggcaggatacccttgagctgcttgggccggaggaatggagcggtattcttatgatgccggagttggcggcagtttatgtgacgccataccatccgtgcattgtcggcctggcagcaagagctaccggatttttatatcagtggacggactgtccgtcctttaccggttatcggaccagaaatccggaagcggtaagactggagcttgcggccgtttatgccgctttacaggagcagaatctggcctgccatatccctcaaagcggacttgatgaagtgggacagcacatagccatgcctgtcggtgtgttggatgcaaaaggcggaacgccattggaactggcctgtctctatgccagctgtctggaggctgtggggctgcatccgctgttgatatttatgaaaagtcatgtattagcgggctgctggctggaggatgaaagtttttcggtctgtgaaacagatgaaataactgcactgacaaagcggatggcggaggggattaccgacattaccgtagtggagtgcctggattttacggcagggaggctggtgggttttgaacaggctcagaagcacggaaaggactggttcagtgacccggataatttcctgtgtgcaatagatgtggcgcaatgccgccgaagcgggattcagccgctgccggaacggatcagggaagacggtagaatccggctggcagaatatgagccccagccggaacagctgctccttcaaaagccagtacaggccggttttgcggaaaatatgccggaggaggcagcaggcccggtgagcaggcagaaggtatgggaacgtcagcttctggacctgagcctgcgcaataccctgcttaatttccgtatgacacgcagcaccctgcagcttctcaccgcggatttgtatgaatgggaggattcgctggcgaaagagaaggaattccttatcagtgaacgtccggaggggcttccgtcacggcttttttcttcctgggtgttacctatagaaacagagcaggatttagtaaaggctattgcgtcggcggaattggatgccgggagaattcggacctttctcccgccgcaggaattgaaagaaaatctgaaaatcctgtaccggaatgccagaaaaagtatggaggagaacggagccaataccctgtatatagcgctcggattccttcggtggtatgagtcggaggtaagtgagcgggccagatatgctcctctaatcttagttcctgtagaactgatccggaaggcgcgtagcggcggatatactgtccgcatgcgtcaggaggaagcccgggtgaatataactctgctggaaatgctccggcagttttacggaattagcataccgggaatggatcctttgccggaggacggcaatggcattgatcttgctttggttttccgtaccgtgcgccgcagtgttatggagaagagccgttgggatgtggaagaattcgcctttctgggtctgttttctttcagccggtttattatgtggaacgatattcacagccgttcccgggaacttatgcggaataaggtggtaaaaagccttctcgacgggcaaatgaaatgggagacccgcgaagatattgtttctgaggaagaactggatgaacgaataacgccggaggaggcggcagtgcccttaagcgccgatgcttctcagctagcggcaattgctgccgcggccgggggagaaagctttgttctgcacgggccgcccgggacgggcaaatcccagactattgcaaatatgattgccaatgccctcggccagggaaaaaccgtgttatttgtcgcggagaaaatggcagcgcttacggtagtttggcaccgcctggaagctatcggcctggatcccttctgcctggagctgcattccaacaaggcaaataaacgttccgttttggaaaagctggagcgtactttggagcttggaaggattaaacatccggaggaatatctgcggacggcaaagcagctgggcgatctgcgccgaaaactgaatgagccgataaaagcgcttcataaaaaacgctttctgggaatttccctgtatgaggcggtctgccggtatgagaaaagaaaaaatgccgacaggggtcttgttttcccttccttcctgcttacagagggaagaaaggaagatatacaggaatggagagaagctgttatacggtatgcggcggctgccggagagattggggatatcaggaaaactccctttttaagttaccagggacgttcctattcacaggagttaaaggactttctgcggcaggatttggaggaagcaggccagcagctgccccggctgagagaggcattacatagattcgccgccgattatggtttttctgatactctgaacagaatagagcttgaggcggcagcagtcctgtcggaagcgattgcggaggaaggaatgctcctgggaaaaataatagacttgggagatataagcgaagtccgttcacagactatccggctgctggagctgggaaaagaattaaataagctggaaggacagctttttcaacgttttaatcctgccatacgggatattgacggaaaagaactgttccgccaatgggaaagcgcgaacagcagcaggtttctttcccggatattccagtgcggcaggctgaaaaagcaattaaaaaagtatgccctgcatcccgaagtaataagaaaggaaacgatggagtccgactgtattcttttgaatcagttcagcagctgcagagaagctttggcggctgtaccggagaagctgtacggcctgtttcctgagatatgggctggggaggttacggactgggataagcttgaaagatccctgtcacgaacattccggctccgggaggcgcttgacggactggagaagaaagcagacagggatcagattcaaaaaatcgttcaggaaggcagggaaagcttttccacagatgcagagtcatttcaacaggaatggaagcggattacagacttactggacaggctgcggcaggagtatggaatcctgaccgatgagacagaactgacaggctgctgtgatggcggtaaagattggctgaaacagctggaaaaacagttttccgggcttaaggatggaatgaacggccttcgtgactgggttttgttcctgcaggccgaagatgaactgctgtcccggggattatcctgtgtgcgggatgctttccggaaaggaggggtggcttctgaagagttggaaatggcctgggaatgcagcatgtaccaggcctgcatacgggatgggataaatgaggagccggcgctggcctgttttcagggggccgcacaggaagccctgatacggcagttcagggatatgactgaaaatttcagacagctgacaatacaggagcttgcggcaaagctgtcctcctccataccggtacatggaattcagagtgccgactcttcggagctggggattctgcagaaggcgatccgcagtaagggaagaatgctttccatacggaagctgtttgatcgggctcccacgctgcttcgcaggctctgtccctgtatgctgatgagccctatttcagtggctcagtatctggatccatcctggccccagttcgatcttgtgatttttgacgaagcatcccagcttcctaccagtgaagcggtgggagccatagccagagggaaaaattgtgtggtggcgggagatcccaaacagctgccgcccaccagcttttttgcctcaggccggaccaatgatgaggaacaggagcttgaggatggagaaagtctgctggaggactgtctcgcgctgtcgatgccggagaaatatcttcagtggcattaccgttccggtcatgaaagcctcattgcatatagcaacaggaggtattataagaacaggctgtataccttcccttctcctgatgataggatatcccgggtgaaatttatgctgacaaaaggatattatgataaaggaaggacaaaacagaaccgggccgaggcggaagccatagcagcggaaatactgcgccgtctgcggacgaatccccaggatagcattggcgttgtcaccttcagcagcgcacagcagaacctgatcgaggatctaatggaggaagcctttagccgggatacagagttggaggtacgaaatgcagcccttcctgagccggtttttataaaaaatctggaaaatgtacagggagacgagcgtgatgtcattttattttccgttggatatgggccggataaggatggaaaggtttccatgaatttcgggccgcttaataaggaaggcggctggaggcgtctgaatgtggcaataaccagggcaaggaaagaaatggtggtatattccgcgatcctgccggaacagattgatctgtccagaacccgctccgaaggggtggccggacttaagggatttctggaatatgcccggaaaggtacacaggccctgccccggcggctgggagaaaaagaggagagagaccggatactggcccgtgagattgcaggggcccttgaagaacggggatataaagcctgctgcggtgtgggctgttcctcctatcagattgatgtcgccgtgttttcggataaggaaccggattcctatatcctgggaattctcctggatggggaaaacgacagggaaaccaaaacagccggagacagatatcttctgcagcctggaatactggaaggaatgggatggaatattatccgcgtatggactatggaatggctggaagctccggaaaaagaacgggatcgtatctgccgctgtctggagaaactcaacatgggaatcgaaacggataatatcaaagaaaaatcagacctgactcctgattgggaaagtgtaaaagaaaggaaacaccttcatccgtatcgccgtgcatatcgggaagcggctctggaaaagcagggaagcccggatacattctatcgtacagaaaaccgggaggcaatctgcagggtaattctgaaacttctgaaagcggaagctcccatcagctggggaatgttaaaaaagaagatattatccctctggtctatttcccgttccggaaatcaggtggagcagattatggaggaggcctgcggcagtcttccgcttcctgtgacttatggaggaaaaacgaaatttttatggaaccccggacaagatccggaggtttatgctgtctatcggacgggagagagggagaaaaggccgatagaagatatctgtcctcaggaaattgccaacgcagtccgggaggtgctggaggaacaaatcagtctttcctattccgattttataagagaaactgccggaaaatttggctatagcagagccggcacagtaatagaagcctctgttgctcagggacttgccctggcagaggagaaaggccgggcagaaacggaggacggagaaaaggaaaagagagtgcggctgaaggcctgagtgcggagagagtttcttccggagaatgtaagtcctccgtaagaagctctcctgagacagttgtcagtccgccttttcttttttcataaccaggttgtaatccgaatcataatacagtccgagatcattacagatccgtacattaatttgcatcaaagcgtcatgatatttttggtaagcaggagacagacggatcatattcggaataaaaatatcattgtatccgcagtcctgaagccttttcataaaatgacgctgggaaatatagacggggtggtatttatagaaaaggctgtttttcatttttacattttgcctggtcttatcccgcagtttccggtattcctcctcggaaggggaagtatacaggcgcagctgttcctccatctgcgcggcgacctgttttatgtcaggtttgggaagccggtacatcagatagctgccaagcctcataaaaagcgggatgcggattttaacattatcccagaagtccagaatattctgataagcttcctgctgttcaggagtggtaatcgtgatctgcaggtagggcagaaaatggttcatgaaaaagtaaccaaaaaatccggggagcatttcctgcatggcatcgccgatacagcggtaatccacggcctggcaaagagcgtctacatttttgtccgatataaatttctgcagtgcttccagttcattctgattctcctggaaaagattcttcttctcttcataaatacgatccagcagcgccttatttgttccggccagcaggtcccggatatcggagatgccgattcccagcttccgatatgcagatatttcttttaaggtttgtacatcctccggcgtataattcctgtacccgttggggtctttttttatatggagaagtccctgctcctcataatatttgacggcccgcttactcaatccggcctgttctgccgcttcattgattttcatagaagaacctcccttctgatagaattgtaaaccggtacgccgcgttcaggtcaagaaaaattttccgaaagggaagaaaaatatttatttttgcagaaaggattgacgaaacatggcagcaggcggtaatatataataaatgaatcattcattcactgggaggcgctatggaaaacgaaagaatcaaggcaatacatgatgcggcggtccacctgttcttgcagcagggctatgccaggacgcagatcagtcatattgcaagagaagtaggggtttccgtgggaaccatttaccatgactttgcgggaaaacaggaaatcatgcattttgttttgaaatgcaccattactcccggttatctggaaaaggattttgagcggcctgtgacggatgatttattccgggggctggaggaagagatcatgcaggtattccggaaatctgcggagaacttttccggacggcttaaacaggggaaggaggcgtatgattttccctccctcatatctgatgctttcgatatgctggcacaatatgctgtgggatgtctgtttattgagaagaatcaattcgatttccctgtgctggcccggaattatcgtgagtaccgggaacattttttcgcggcaatgaccggctacctgtctttatttatggagaaggggatgataaggcctttgaaaaacaaggagcttaccacagcactgatcgtggagcagctggcctggtgggccatggatatgcggtacaattccttcgaagagcatcacatatccctggaggatgccaaagaggtatgcatggataacctggttcacgcttatatgcaggtttaagaaaattatcagggcagattccgcccttttaattttgtctggcaagtaaatgaatcattcattcatatgaaacatataactttatttttcaggagcgctgcggcgcagacaggagcggtaatgaataaaaaactgaaaaaaatagcaggcggatgtattttatggttcaccggatttacccttgcaggctgttttagcccgggtggggaacggatagtcaatgaaatggtgtttgatctcaataatatctctgatttggaaatagcgtatgacgaagaaaatgtcaccttctgcgacggccgcagcgaaaaattggtaatcagggagtacatgaccgacgacaatcgccgttattatgcgaatactgaaatacaggggaaacggctgcacatcagtgaagggggaagacctctttttaaggatggcttttcctgtcgggtagaggtattcctgcctgcttcctataatcgggatctgacagtgagtaccaccagcggagtgattgatatgacacaggcggatctgatgctggattccttacgggcggagactacttccggtgaaatccgtctggaacaggtaaaggcagcctgcctggatctggaaaccaccagagggatcctggatttaggaacccttctggccgatcaaatcacgatacacagcacggaaggaagggtgaatatatcccgcatggaagggaatgtaaactatacctccacacatggaagcctgatggtagatgctgctgtgggagccggtatttatcagacttcgaatgacggactgctgcagcttagatatgaaaaagcggatggtgatctgcagttttataacaaaaatggagatatcctgctcacacttccctcatcgctcgcttttgagctggaggcggtgagcaggaacggttcggtatctgcagatttcggaaaggatgaaaaggaggagaagggatgggtaaaagggaagaatggaagtgctccctatgtgaagatcagtctggaatccagaaacggaaagctggaaataaaaaaagagtgaggggacaggagctggacagactgcagtcgctgcgggatggaaaagtaatctgccctgttataaactgccatctgcagctggagggcagcttcgatcggaaaaggctggcccgggcggtagaacagacacgaagctatgtgccggagcttttttattcctatgacaaaagaagaggctgctttacagagaatcattcggaaaaattccgtgtcctgtaccccatagaaaataatctgccgcgaatcgccggaagaggatgggatcccacgacgggcccgcagcttcggatagggtacaggcaggagggaaaaatgacatctcttgtaatcggaatgacacatttcatcagtgatgcaaaaggggttcttacatatatttctcttcttaccgccctttataatggggaaacaccgccctttaaaccgggaaatacacgttccatagccttcatggtacataaaacacgggttggcccaagtacctgtcaggaaaaacaggtggtaagacagaataaaaactccggcctgcccgggaagaatggcggcggcctgttctgcctgaatatggagctgtcctcaccgcagatggaacaattatcccataaggcacatgaatacggagcgactatgaacgaagtattcatggcggcatacgcccgggtaatcacccgcctatatggcatggaaacggttctcataccatgtcccgctgatctgagacgcttcggaaattttgctcatgttcttaccgtagccaacatgacgggattataccgggttgcggttgaagtcaggaaggagcaccgcttcacagataccctgcagcagctccatttggaaatgctcacgcagaaaaaaagaagacgctgcttcgccggcctttccctgctgcagcggctgggaggccggattccgccggcccttttgaaatatccggtaaggacaggatacccgtcggtacctttttcttacagcaacataggtgtgatagacagtgaaggggtacatttccgcggatgccgtaccagaaaatgttttcttaccggtgcataccgcaaagcgcccgattttcagcttacggtaagtacctatcagaatacagccaccctgaacactgtcctatgcggaaatgacgtaagacgccggaatgcggcacgcgtcctatccctggtgagaagggaattattggattggatccgggaggcagagaagtaaaaggaatacatatacatggccgctattttacgtttacaggaatccaaatctcactgtaataatcaggagaagaggtatcacaaggagtatacatttcgatattcagcccaagggcgatttcataccgggtattaccgggaagccattcattgaaaatccgcgtattcgtggcctggaatgcaccgggaagggggcctgtgcagctgaacttcacccaggtacaggcagggatttccattaccttcatgccctccggaaccacatccccttcataatcccctgcgatgagataccggaagcttatcggatcctcttcctctgtaacacagatgccgtatttacctaaatttctgctcccacccagttgagaacagcacatccccctttccttttgacagaaccatgcccagtagggaggaatttcatcataggcggtgtcataaagaaaggtacgctccaacccgataaccggaaaggaatccatctgttccagggtaaaatgcagttggctcccgccttcaaccgatatcttaatcagaaggggaagaaaaacatgaagtctgtgaggctgtttcttcagctggaccggcgccagcccatgaaaacggctgaaggctttggtaaagctttcaggagtttcgtatctgtatttataagcaaggtcaatcaccttatcgtttcctgtcaggatatccagggctgcgagatacaggcgtctgttgcgcagataagttccaactgtcattccggtaatgattttaaagcccttctgaaaataaaaagaggagatactcacctgccgcgcaatatcatccggagtgatatcctccagcagatgatcttccatataattgatggactccttcattgcttccagccattccattttccattctccctgcagtatatgtcttattttccgccaaatgttatataaatcgcgctgatgcggaggacctcttataagatataataacataaatgaacgcggaagggagaacataaatggaaagctgttttagtggagaattcagaaaatttgtattataataaagctgcaaagataaaaacacagagcatgtctgagacatgcggagccggttggtagtccggccggaagcagcaagcctgcttctaagtagccctcctccttggtcgtccgttctttgttcataaaattaaaggaggattcttttatggacagatcgacggagttggtgaggcagacggcagtgtttcgggtatttttcgaggaacccttctgggtaggcgtttttgagcgcatccgggagggaagggtatcggttttcaaggtgacgtttggcgcggaaccgaaggattatgaggtgcttgcattccttctggaaaattatgataagctgcggtttggcccgtcagtggagactgtggtaaaggaaacgggatccaatcccaaacggatgcagcggatggcccaaagggagcttcgggagccgggcatcgggacaaaatcccagcaggcattaaaactgcagcaggagcttatgaaaacggagcgccgcgtctatagccgggagcaaaaggaggctgaaaaggaacggcagtttgagcagaagcagcagaaaagaaaagagaaacacaggggccgataaggtctctgtgtttctcttttgagtaaggattattcagaaaaactacttgacttagtagtaaaaatatactaacatacagttagtagtaaatagatactaacaatccaattccgacaaaggaggaaaaccatgacttcatctgagcaggaattcctgaacaattaccatccggaggattatgaaaaaccatcggttgccgtagatttactggtatttaccatagaagaagccgcactgaagctggtcatgataaggagagaagagatgccctttcaaaacaagctggctctgccgggtgtgtttgttaatatccgggagtctctggaggaagcggcatacaggggaatcgaagaggaaacaggactgacagatatttatctggagcagctgtatacctggggggatccggagcgtgacccgagaatgcggatcatatcggtttcctacatggcgcttgtgcacatacataaaattcatctgagtaagggaaaaaggacaacgcaggtgagtctgtatcctgtggaagagctgcttgcggaagagacggaaatagccttcgaccataaaaagatgatcgcctgtgcaagggaacggataaaaaataaaacggaatatacggatgtggccttcgcctttctgccggaagaattcacccttccccagcttcagcggatttatgaaatcctgctgggaaaagaattatataaggccaatttccgtaaaaaggtaaaggatctggtggaggagacggaacattatacaaccggggtttcccacaggcccagccagtattacagacggaaggggaacggagaggaggtcggaaaaaatgagcagatggaaagcatttctgaaagcggaaaccgctgactggaaaaaatgggaggctgcctggctgtttttggcagcaggaatcattgtccttctttctctgtattggggagatgatgcaagaggaatcacagcagccgtaacgggagtgatctgtgttatacttaccggaaagggaaagatgagctgttacctgttcgggctggtgaatacgattctgtatgcctggatagcatgggatgcccgatatttgggagaggtcatgctgaatgtggtttattatgtccccatgcagttcgccggctggtttatgtggaaaaagcacaggaatcaggaaaccggggaggtggtcaaaacaaggctttccctgaagggagatctggcggctgccggaatcgccgctgcctccatttacggctatggcctgattttgaaagcattgggagggaacctgcccttcacggacagtctgtccacctgtctgagtgtgctggctatgctgttcagcgtaaagcgtctgatggagcagtggatactctggattgtggtggatgtggtaacagtatatatgtgggcggtggattatgcaaacgggggaacggatatcgctacgctccttatgtggtccgtttatctgttgaatgccgtaattatgcttcataaatggtatgtggaaagcaggagggcggaacagaaatgaaatataaaacagggatgttcgggggttcctttgatccccttcatacagggcatatacacgatatcataagggcggcttccatgtgtgaggagctttatgtgatgatcagctggtgtgaggggcgggagtccacctcaaaggagcttcgttatcgctggcttcataacagctgccgccatctgcctaatgtgaagctgcggcttgtggaagataaagccgtggataaggaagcctataatacagattatttctgggaaaaaggggcggcagatatcaaaggcatcataggaaagcccatagatgccgtattctgcggtactgattatctgggtaccaaccggtttgaaagcctgtactgcccggaaagtgaaattatttattttgacaggcaggaggtccctgtcagctccacggatatccggaaatgggcatttgataactgggactatattcccgcagtctgcaggccctattatgcaggaaaggttctggtagtgggaggggagagcaccggaaaatcaatccttgtaaaaaatctggctcttgcctataacacctgctgtgtggaagaagtgggacgggatgtcactgattttgcaggaggagaggaatggatgattgcggaggactttcaccagatcctgctccgccacaaggtgaaggagttggatgccctgaaagcctgcagcagagtattatttgtggatacagatgcccttaccaccaggttttattcccggttcctgttatgcagggaagaggaaatccgccaatgcgaggcactggcggatgcgataacagccttaaacagctatgacctgattctgtttctggagcccaccgttgagtttgtccaggatggcaccagaaatgagaggatcgccgctgacagagagaaatacagcagacagataaaagaactttttgaacagaaggggctttcttatgtttctctggcgggagattatctggaacgctttaaccgggcaaaactcctgattaaggaaaagctggggcttgacaccagatggtgattcatccgcgctccggcatatgaaagccctccagggcctgattcaggaaatcgttgaagggcctcatcagcagaaaaacagcggccgcgttttgtgcaaagaactccgcatgatccagctcttcatcagaaacaggatattcgattgcccagcttttatgcttcaggtattcactgacggaaagcgccgcatcatattccctggggacgtttttcagcttttccccgatcagaacaaacttttctgcaaaggctggttcccggaggatcgcttcccattgctctccatgggaaacgatgtgatttcgtatcatggaggtggcatccttaaactgggatgcaaaaagccctcctccgagaaaactgtttcccggttcaaggtggatatagaagcctaccggaatggggagccgtcctgccggggacagatgcgctctcagggaggcatggtaaggggatttgtcatggctgaaacgggtatcccgggcataccgcatgataaaatctttcacatcatgtccccccgacatggggcagccggcggcggaaagctcagaaagaatccggcataaaagcttttcaaagtcggcattggcttccttctgccagctcttgttggcactcatccattcctttgtattattttccttcagagcgttcagaaaggccagcatacaattatcattcatatcacattttttctccttatgcgttcataatatagctgcatctgtcggaactgagaaaatcagaaaggaattttctggcctcggcagtggcgcggaaggtaggtagggaagaaaatagcagcgaaaggtcatcgatttcctccatttgcttaacaaattcatccgcgtccggattgggaaccgccagcggcgaatattccacagcttccggatggatgcggtgtgtggcggctgcgtaggggattcttcttttgcaggcgcattttccgccggtcagtccgcagtattctttcaggaaagcggacattttcttcctggccctggacagcttctgacggtaattttcaggcgtcatatccagaatgtcaccggcaatccggctgtcggcctgaaacatggttcccagaataaagatgcagcggctttccggatccagacattgaagcatgacattggtacaggagagcttcagctcctgttccagaaggtcatgatccagttccggggaaagggcgggtatttccttttcctttccgctgtcaatatccgctccataatattcgaagcttaaaggatggttggcaaacatatgctttttgtaatccttcagatgattgacggcaatgcggaaaacccaggtggtaaaggcgctttccccacggaatgaggaaagatgtgtcataacctttaaaaggatttcctgtgtggcgtcctctgcatcgggtatgcttcccagcatacgcagggaaagatggaatacgggatcctgtatgcccgtaagcagttcctccagggccttacgatccccggaaattgccttttccacagcatcgggggctatttcagtgcgattgttattcatagaattcttcctcctttatacagttagactgcggaaaacatactttgtgacaaaaaatatttatatatccttattaattgttcttctgacggagtggatcgccggtttaaaatatttcggccagaaatgtactgcatccggattagccgtttcaaaactcacatgaagataggatttacgcttttccctgcagatggcgaatactttttccagcaaagcggtaccgatgcctcttccgcgatagtcggaatgtatgaatgcacctataaattttatggaagaactgtcagcagcagttaaatgttcaaaatgatatcccggatccagggaaaaactcattactccgataattctgcctttatcacgtgcggtcagtatataaccatccttcagaaattccgtgatttcggctgctgaatattcattcctctttaagaagacaggacttgccgcataatagtcgtttgaaaggttagcgaatgcaagcagttcatcaacatcctttattccggcggatgatatctcataatcgcatgtaacggataaattcagcgcaccggtcgattgacatgcatcgatgacataggagccgaagccaatatcatataatttttctctgagggggtgattatcagaataagtcatccataaatggttaaatcgcttatcatccacccatttctgagcggcatggtaatacatttcctcatatattctgatatcatcatgtgacgaagcagcgtgggcagcagtgggtaggaatgcagtcctttccttatgaaaatcaaaatacatccatgccatatacccgatgatatcgctgtcacgttttattattatggcattctctttttctgtttgctctttgagatatgtatctataaccggcagacctccggcagtaaaatccgggaatgaattactgtaacaatacctgacaaactgctctttccataaattaacggcatccggaatatgttctgctttcataggaactattcttatcattttttctcctgtctgcacacttttgtgtgctcgttattaaaatgacatccaattcaggaatgctgaaagcgctttcttttctactacacttcctgtctgttcttttatctgaagatttcatatagttaatcaataaaaaccataccatacatgtgattttattacaatgctgtttcattgaccttgcaagtacatataccttttcgacaggtgatatttcaggaaatacggataaatgggagagcaggaaaggaatatggataggatagaagctgtattcctgctagacacgatatgggaatactcatgtaaaaaagaaaatttaggatcattccagtatttaattttagaaaatcttatgctatactgtgtgtaaacgcttacattaaaaggggaatgatatgggactgatagcattaacagaaaaactgaggaaaccggatcgggaatatacggcctttcccttctggttcttcaacggcgattttacagatgaggagatcatacgtcaattaagggatttcagggataaggggatttacggatttgtcctgcatcccagaatgggaatcccggaaagcattccttacctgtccgatgcttttatgcattatgtaaaaactgcggtggaaacggcccacgaagaagggatgcaggtcgtgctgtatgatgaaggcatgtatccttccggctccgctcatggcatgattgcggctgccgatccggccctggcatccatcggccttacactggaagaggactgggtcgagaacgatcacgtcggtgaggagagggtggttgcccggctggcaaacggcaaatttctggtatgcaggcataaccagggtacgatacggggcattcatttcggggaggatgacggggagccgagagcgcctttaagcgcagatattctgaatccgaaggcggtggatttgttcctgaagttcacccatgaacgctattatgaggtcctgaaggaatatttcggctctacaataatcggcttttttaccgatgaacccagtattcttggcagaaacgggctgggcactgcggaaaagcctttctttccctggacgccggggctggaagaggaaatctgcagccggggcggaaaaacagaggagctggaagctctttttgaaggaaaggaaaataagacaaccgctgtttatcatcaggtgattacagacagggaaggctgggtatattacgggaagctgtcttcctggtgtcaagcccatggcatcgcccttatgggacatcctcatcaaagcgatgatattgatgtgcagcagtatttccatatacccgggcaggatttggccctgcgctgggtggcgccggaaaaaggcggcctggaggggatggacagtgtcatgggaaaatgctcttcggatgcagcaaggctgatgggaaggcggcgaaattccaatgaatgctttggcgcatgcaacagaacggcggatggtgtcacgattccctggtattttacgggcagcgatatgaaatggtatctggactggctggcggtccggggtgtgaatctgtttatacctcatgcattttattacagtattgaaggcgcgagaaaggaagagcgtccgccggatgtgggggcaaacagtatctggtggaaccattatgaacagatatccggctatatgagccgactgtcctatatgggaacggatgggaagaactgtgccgatgtggcggttttgtgtgataatcgaaacctgcactggaaggaagtaaaggaattttatgaaaaacaggtggaattcaattatcttcccctgcgttgcctggaaggctgtagggaagaacatgggaaactggtttgcgccggacaggcgtacagctgtgttttaggagatgaagttcacagcttactgcccggcgggatgccgtcggtgaaaagaatccgttcagcggaagaagcgggtcatcgggagttgtggctgaagaatgcctgtccctcattgcgtcttactcattttatcaaggaagggaaggaatgcttctttattgtgaatgagggagagacagctgtctcggaggaggcggaaatagaagcaggaaataaggccgacagctgtctggcagcctatgacctgtggaagaatgaatgctatggaatctcggtacggcagcaggagggccgcatggcctttcatctggagctggcaaggagggaaagcctgcttttgattctaagtacgcgggaagagtacgaacaggctggcctcaggtaccgtccgggaaaagaagaaataaaaatccaaaactggaagctggtcggagaaaatacggatgctcttcaaaaggaatatgaaggaagcttttattgggaaaaggaagccattggaaaggagaccattggaaagaaagataccgaccgggtacttcgtgtttcggcggaagagatggtggaatattacataaacggcagctttgcaggcgttaccttctggaatcctcatgaggtgaagcttactccatggctgaaagaaggagaaaatcatatccgtattgtggtgacgggcaatttggcaaaccggtacgggaatgcggaagtctattatggattattatgagaagaaataacaaaaagagtttctgaaaggaaacggtaaaagaaagccttgtacttgtcccgggaggtatatcataatacttcccgggaatcgggtacaaggctttttttaatgtacagcagtattggcgcgccgtattatttagctttaatttcgctgtgaagctcctgcagggatttcacatctccgttgccatggtctttcacatatttaatgccatgggcggttgcgagcgcggcagcaatggtggtcatatagggaattttcgctttgatggctgctttgcgaagatagctgtcgtcatgtacgctttctttaccgacggggctgttgaccacaagctggattttgccgttggtaatgagatccaggatgttgggcctgccttcatacagcttgttgactttttccgcctcgattccggcttcccggatcaggctgcaggtatttccggtcgctacgatatggaaaccggcatctgcaaaggcctgtgcaacctcaaccacttccgctttatccttgcggttcacggaaatcagcacggtgccttccagaggaagacgggactgtgttgcctcctgggccttatagaaggcttcgccataggaataggaaagtccgagcacttcaccggtagaacgcatttccggcccgaggacaggatctacctccgggaacatattgaaggggaataccgcttcctttactccgtaataaggaatatgctgctcatgcagagtgggtacgggagagggtttcccggtcagctcggaggttatgatatcgatggccagcggcaccatacggatattgcagaccttggataccagcggaaccgtacgggatgcgcggggattggcctccagcacataaaccctgccgttttcaatggcatactgcatgttcatcaggcctttgacatgcatttcctccgctatttttctggtatattcctttatggtttccacattttccgcagaaatatggacggaaggaatgatgcaggcagaatctccggaatgaacgcctgcaagctcgatatgctccataacggcaggaacaaaagcatgggtaccgtcactgatggcgtcggcttcacattccatggcatggttcaggaaacggtcaatgaggatggggcggtcgggagttacgcctaccgcggctttcatatagcctgccatgctttcctcatcatatacaacttccatacctctgccgcctaatacataggaagggcgaaccatgacaggatagccgatccgtccggcaatctccagcgcttcttccacagtggtggccattcctgattccggcatgggtatttccagtttttccatcatggcgcggaacagatctctgtcttccgccagatcgatgacggaaggggcggtgccgagaattttaactccgttcttttccagttcatttgccagattcagcggggtctggccgccgaactgtgcaataacacccacgggcttttcttttttgtagatgctcagaacgtcctccagggtcagaggttcaaagtacagtttatcggaggtatcgtaatccgtggacacggtttccgggttgcagttgacaatgatggtttcaaagcccagctttttcagggcgagtgaagcatggacgcagcaatagtcaaattcaataccctggccgatgcggttggggcctccgcccagaatcattactttgggcttgtcggtgcttatcgggtttttgtcttctccgttgtaggtggagaagtagtaagcactgtccggcgtgccgctgacatggacgccttcccaggtttcctccacacccagctgaatgcggcggctgcggatgtcgtcttcaggaaccgccagaatctggcttaagtatttatcggaaaagccgtcttttttagccttgataaggctttcgtcggaaggaaggcttcctctgcatgctgcaagggcttcttcttcctccaccagttcctgcatctgtctgataaaataggttttcacctttgtgatttcatggatttcttctgctgtagcgcccttgcggagagcttcgtacatgatgaaatgacgttcgctggaaggggtgatcagaagggcgagaagctgttcttttgttttgcttcccaggttcccggcattccccaggccatagcggcctgtttccagactgcggatcgctttctggaaggcttccttataatttttgccgatgctcatcacttcgcctaccgcgcgcatctgggtgcccagcttatcctcaacacccttgaatttttcgaaggcccagcgggcaaatttgataaccacataatcaccgtcgggcacatatttatccagagttccgtacttgccgcaggggatgtccttcagggtaaggccgcatgccagcatggcggaaaccagtgcgatggggaacccggtagccttggaggccagtgcggaggaacgggaggtcctggggttgatttcaataacaacaatacggtcggtttccgggtcgtgggcgaattgtacatttgtgccgccgatgacctgaacgctttccacgatccggtaggcctgctcctgcagacgcatctggcagtcctgggatatggtgagcatgggagcggagcagaaagaatcaccggtatgtacgccaaggggatcgatgttttcaatgaagcagacggtgatcatgttgttttcacagtctcttacaatttccagctccagttcttcccagccgagaatggattcttccacgagaacctggcctaccatactggcctgaaggcctcttgcacaaacggttttgagctcgtccacattgtaaacaagtccgccgcctgcgccgcccatggtataggcgggacggagaacgacaggataacccaggcggtcggcgattgcaagcgcttcttccacactgtaggcaacttcactgcgggccatttcaatgccaagctcgttcatggcttttttgaattcaatacgatcttcgccgcgttcgatggcatctacctggacgccgattactttaacgtcgtatttttccagaatgccggctttattcagctctgaacacagattcagcccggactgtcctcccagattgggaagaagcgcatcgggcctctctttggcaataatctgctccagccgctctacattaagcggctcaatataggttacatctgctgtttccggatccgtcatgatcgttgccggattggaattgacaagaacgatctcatatccaagcttacgcagcgccttacaggcctgagtgccggaataatcgaattcgcaggcctggccgatgatgatcgggccggagccgatgattagtactttgtgaatgtctgttctttgtgacataattcctccattctgctgccagaatagcagcgctgattaagggggaaaacaggtacgtgcgcttccaccgcagccgtacgcaagccaaggcggaaagaaccgtttgatccctcccgcacaatcttttgtaatttccctttggagattattatataggatattgaggaaaaggggaagggggtgtttgattatttagcttgggtctttgaaggtgtttaggaggatttgggggatgagggtgtttcgggtgaatttgcggtgttggatttcttcttttgttcttccgctgattagggatttgtttgtgatggtgttgtctgagacgctgaaaagggcggttagggggattgcggctgttttggcggctctgaaggcggcggctgtttccatttctatgatgttgcagcccatggctgttatttcttcgatgtgggcgaattgggcgaagatggtgtcgatgctgaaggttctgcctttgtgtagggggacgttgttggtttggcagatgtggcgtgcgtgtttgcagagggtgttttgcagttgggggtcggggtattgtttttcgccgaaggggtcggtgtgggtgagggtatcggcggttatgtagcggctggctccgtcgccgcagatgctgtattcggggatgacgatgtcgccgatgtttatttgggggtcaagggagccgacggagccgatgaagatggctctgcggcatttggtgacgccgagtgagaggagggtgtccatgaggacgggggcgcctatgccggtttttatgtaggtgatgttgaggctgttgttttttatgttccagacttttatggaggcggagggggattcgcttaggtattcggtgtcgccaaggtcttgcaggatgtcgggttcccaccagggggcgaggatgacgttttcgttaatttgatcagggcggacgcctgtgccgtgaaggcatatgtcttcttctgtggaaccgtatttttttattgcgtcgatcaggtgtttgtagttcatatgtgtttacctctcagtgtgttgggttgttgttacaggtgcggttttcggcttcccattgtcaggggtattgttttcagcggccgaggagaaaacgggatatcaggctgggggcgttgataaagtcgtaggagccgtagcggcgggcgaggaaaaacaggcggaggacaagaagctggtagcggatgtaaaaagcagggatgctcatgtgggcaggggggaggaggacatgggtgtaatcccatttgcgccagtctgtggtgaggagtttttctttgcagtcgtcgtacatctgtgtcccggggaggggagtgatgatggaggggatgacgtattcgagctgctgttcttttacccagcggtacatggagatgaaatcggcgggggtaaagtctgtgtcgattatcatcatggcgtagaggcctgcgtggatgcttttcataaagcggatgcaggagaggctgtcgtctacttcgatttttttgtcgtatttttggaggtagttatcacggactgcttcaaagcctacgatgaaatagcggaagccgatctgagtgagttcttttatgaggtctttgtttttcagaataaaatcgcatcttccatagcagatgaaatttttgtttattttgagttctcggatcgcggcaataaattgtgagagggtggtaggatccacgagaaaattgtcgtctataatgtagatgttgtcgcattggatgtttcggatttcttccgcgaagttccggacatctttatgtacgtagcggccgcagttcatcatggtgcggtagcagaaggtgcatttgtgggagcaggaataggcaaaacggacacaggccaggggattgtgcttgaggagccggaagcgggactggtattggtagaaatgggagcggtctatatcccgggggaggaggttgatatcaaaggggtgtatcgtgttttccgtccagctgccgtctttcctgcggtaacacaggccgttcaggttttccagcagggaggagggaaaatccggttctgacaggagggaggcaagggctgagatgacacagggatcgtaggaacgggagatataatctacggtgtccttatacagggagcggtaattgtgttcggcgaaaacacctccgagaatcgtggcggttttgggggagaaggctttggtacgctgcatgtagtcaagcatgtaggggacttgcttaactacgccgtcagcatagaccaggtcgggggcaaaagaggataaaagttcttcaaaacaggccggctcccggtccggatcatagatgcggaccgggtagccggcttgtttgaggaccgtgtataaaatttctgtttcaagcggttcgttttccacaataccgagggcgttgaaatgagttcgtgtttcttctgtatggattaacaggatgcgggtcggattcatgattgttcctttcagccttttgttaaaaaaatgagttgcaattattttatcatagaaaagactgttgtgcatgaaatattattttctctttccggtaaggcagaggtgttgttaatggccgggaggcttaggcttctccttttagagcggtatggctatcgtccggaagaaccggagcagcagcggaaagctctttgtgaagccgcagggccataaatacggtgatggcggcggagagtacatccgcgatcggctgggcacagataataccggttattccgctgaagaaaggaagaatcagtatgacgggaacaaagcagatcccctgtctgcaggcaccgaggaagcagccttcctttgccttgcccattgccaggaaaagagaggaataaacggtatagaaaccgaaaggcaggaaggaaaggccgtttatccgtaaggcagcctggcctacgcgtatcatttctgtgtctccctttgtaaattgagatatgatggatgttgaaaataaggcggcggctaatccgaaggcgatacagaatatcgtagaccataaaatggaggttttgattgcctcacgcaggcggctatagtttcgtgagccgtagctgtatccggcaatgggctggaatcctttgataaaaccaaataccataaggcttcctacggacataattcttgttacagggcccatggcggccagtacggaatcgccgtatcctttcgctgcgctgttgatgagggttatggaaaggcttgtcagcagctggaataccagggtgggaattcctattttcaatatttcagacatgatttctctggaaaaacagcatttctttatgtgaaagctgaaaacacttttcccactgaatatataacataaatataccagagtggaaacaagctgggatatggcggtggcgatggcggctccggctacgccgagattcagggtataaatgaaaatgggatccaggatcacgttcaggacggcgccggttatgagtacgcacatggtggttttggcggcgccttcgcttgatatgatattgttcattgtcacattaaatacattgaaaatagaagaggctatataaatgcccgtataggttatggcgtacggcatgatgctttccgtggctcccagctgtctgaggagcgggtgaaggaaaagcagggaacataggatgactgcggctccgacagagatgctgctgtataaagcggtactggcagcctggtcggctgtttttttgtctccgcgtcccaataagcgggataggtaggaggctgcgccgtttccgaacagaagccccagccccacaacaacctgccccagaggataggcgatggtaatcgcccccatttggctggttcccagtcctccgacaaaataggcatccaccagattatataatgcattaatcatcattccgatcatggtagggagtccgagagccagaagcgccctgggaacaggtgtacttcccagcagctccatttttttgtttttttcgttcatgagtaaatctcctttcttgtgatgtaaaatataataatataaattatagtacttgatccgcaggacatatagtactataatttatagtacttgtcaagaacaaaaaggaggacgtcatggctaccattgatttgatagtgctgggaatattgaaaaaagaggcattaagcgcctatgatattcagaaaacagtggagtaccgtaatatatccaggtgggtgaaaataagcactccatccatatataagaaggttctccagctcgaggaaaaaggctatatcagcagtacgattgtaaaagaggggaaaatggctgaaaaagcggtctattccttaacggaaacaggaaatgaagaatttgaaaagcttatgctggatattgcatccaagcctatctatatttttcttgattttaatgcggtaatagtcaatctggacagtctgtctccggaacggcagagacagtgtctggacagtatagaaaagaatgttaaaatcatcaagtcatatctggaggataatattgaacggaaaaaagacatgcccgaaatccctgaaacaggaaaggcggttatgcagcagcagtatattttatttcaggcaattgaaacatggattgcatcggtaaaggaaggctttggaaagcagtcttgatttttccgaagccaatgccttttgagatagaaaaagagactgttgcagatagatatctggcctgaaagatatgtccggaagcgatcggtttatgttgacatatactatatattatagtagtatattttatagaacattacaagcggcatggcagcagctgtatagtgtctgaaacaggcaggaacagctgaagcgagagccggatggcgtagagtaacgccggtttcaggaaatttacgaaggaggaaaattcctctgctcgtcagaggtcaaatttctgaagaaattgtattttgctccgccaaacaaggaggaaattatgtacgaatcgagatgcggcgtatgctgtgacagctgcgaaagaaaagaggctgttcactgcagcggatgtctgaacatggaaaagcctttctggggaggcttatgcggtgtaaaagcctgctgtgaggagaaaaaactcaatcactgcggggaatgcacagagtttccctgtgagatgttaagcttaatgggagtggatcagggcttcgatcccactattaagattgaacagtgcagaaagtgggcggaagaagggaaaagctgaccggatgcagcagttcagatgcctgaattgtcaggggcagttataaaggcagatgaaatatggaaagatggtctgaaggccgcaggatttaggcattgccaaataatcctgcggccttaatcctgcgctgcattaatgtcacagtaatggaatgctgtactagtgctcccggctggatgaagcactggctgttttgcacaaattttggttgcaaccgggactgcggtgaggcataatgaatatatggatgtaactgtgaaggcattgaacagttatatatggataaaggattacatatgacataaggggacagtccggcaggacagcaaagggggcttacgtgaaacaaaacaggaatcgcaacaagtatacctttggtttaggcacgataggcagggatatggtctattccatggtgagtatgtatctgatttattatcttacggacattattgaactgcctacgtccaccttgtggtggattacggttattgttctttgtgcccgtatttttgatgcgctcaacgatccgatcatgggggtgatcgttgataataccaaaacccggttcgggaaatttaaaccctggatcgcgctgggggctttggtatccggtatgcttaccgtattgcttttcacggatttcggtcttcagggagcgggatatattgcggtgtttgccctgatctatatcgcctgggggctggcctataccgcgaatgatatttcctactggtccatgctgccgtcgctgagcctggaacagaaggaaagggagcaaatcggcgcggtggcgcgaatctgtgccaatgtgggcctgtttttcgtggtagcgggtattgtgcctatcacctcggttttcggaaatgcgcttggcagtatgcagaagggatattttgcattttctcttctggtagtcggaattatgtgggcgggacagtgtattacccttgtcggcgtaaaggagcccaggaatcttgtggcgcagaataagcatacgagcctgaaagaactgcttaaggtgatattcggaaatgatcagctgctgtatacggcggtttccatggctcttttcatgataggctatacgacaaccacaagcttcggactttattttttcaaatatgcttatggggatgaagggatgtattccatctttgctttgattctgggagtttcccaaattgcggctctggtggtgttccctcttatcagccggcatttcgaacgcaggactttgtatgctttttccacgggactggtggtggccggttatgtgatatttttctttgctccgcttgataccatgctgtttattggtattgcgggcgtgctgctttttatcgggcaggcgtttatccagttgatgatgctgatgtttcttgcggatacggtggaatacggcttctggaaatcaggcaggcgtaatgacagcgttaccttttccatccagccgttcatcaataagatgggaggggccgtggcaagcggcgttgtgagcgctaccgtcattgtttccgggataaaggatgcacagagtgcggagcaggtgacggcaggggggcttctcatgatgaagatggctatgatgatttttcctctgctgtgtattctggccgggttcctgctttatctgaaaaagtataaaatcgacagcagtttatatgcccggatcctgaaggaactgagggaacggggcgatatacgtaccggggaaggagagtaaggcatgaatgaaaaactgacgatgaaaagcagcctgagggaggtttatgcacacccggtcggccatgatatcctgaaaaaaatcatgcttcagacaggcatgcaggagcggcttctggacaaccggataacaggcgccatgtctctgcaggcggtggcggctttggtgaaaaaaatactggatgacagcttctggcagacctttctggacctgctgaacagtgaaccggattatccggatgaaaccgattcggaaattgtgaaaaaatggtggaaggaggctgttttctatcagatttacccccggagcttctgcgatgggaacggggacggaatcggtgatattaagggaattatcggaaagctggattacctttccagacttggggtggacgcggtatggctttctcccgtgtatgattcccccaatgacgataacggctatgacataagggattatttaaaaataatgcaggaattcggcaccatggaagaattcgacgccctcctgtcaggcctgcacagccgcggcatgcgcctgattatggatctggtggtaaaccatacctccgatgaacatgcctggtttcaggaggcggtgcgggatccttacggcccgtaccatgactattatctgttccgggaaaacgaagtcgggcgggaacccaataactggacctcttttttcggtcagggaaaatacggggatgcctggaggtatatcccggaaaatgacgaatgggcgctccatcttttttccaaaaaacaaatggatctcaactgggacaatccccggatgcgccgggaaatttacactatggtcaagtggtggctggaaaagggtgtggacgggttccgactggatgtcattaactatatttccaaagaagagggactgccctatggaaatgagtctgtgggaaatatgctgggctatgtgggaattgagcattatttttatggcccgcaccttcatgattatctgcgtgaactgcgttgcatggcttttgacccctatgaagctttttccgtgggagagactccgggcatcggtatgcagatgggcaagcttctcaccggggaggacaggcatgagctggatatgattttttccttcgatcatctggagacgccggggcatatgcggttcgatgagtaccgctatgatctgaattatctgaagcagtattatacggagtggatggaagggtatggaaaccgctgctggatgtcacttttttatgataaccatgacaacccgcggatgatttccaaagtcagcgaggatccccgctaccgttttgccataggaaagctgctggggatgatacagttcacattgaagggaacgccttttttataccagggacaggagctgggagccgtcaatgtgccttttacggatatgtcccagatccgggatgtggaaagcatcaatctgtacgaagagctctgccggagtatgagcgaggaagaggccttccgcaggattctggcggggacaagggatcatgccagagccatgatgaagtggcaggaggcagaagaacagaaagaggacagggattccatctattatttttacaaaaagctgattgccctccggaaaaaatatccggccctcatttacggagaaatcagaattaccaaccattccaggaaaaatctgttcacctggttccgggagcttgacggagaggagttttacatagaatgcaacctcagcgaaaagcctctgacgaggccggcaaggccggagggcttccgcggcctgctgtccagctgtaaagagccgggaaggctgatgcagccctatgaagcatgcctgtaccggaaagaaatgagatagtactgcagaagaggtaagcctgatggaaaagaaaagcaatgcatcaagtcctgtcatattactgctctctgttttctttatattcacggaaagcattcgtatttttacaggagaaaaagaaccctattatacagaggatatgcagctgatctggctgaccggagcctggtttttagtgatcgcggccctgcttctggcctgttttatactgtgtatccggggaaaaaggctgtggtggcacaggctcctgcggattcccctgaccatgtatttcctttactgcggggcggttgccgtactgctgctggcgggaggctatggccttttattcctgctgcccgcgctgataggaggtattgtggtagctgtggcagttattaatgaaaagagcgtgtaactcaaatttcgcccatgcccctgtcccctgcggccagcgatttcgtgactgccgtccggtttggattcccttccttccctctgtcggctatgcagggatccttgcaggggacgctttcgctcggataaacacgcagcggtactaaggccgcaaagtacgcggcctaaggaccggcgagtttatacgccccttacaggaaaccctgcatagccgacagagggaaggaagggaatccaaaccggacggcagtcacgaaatcgctggccgcaggggacaggggcatgggtgaagtttgagcatatagaaataagtcagaaaaatacaaatagtctgcaagattttacattttcaaatgacggcaaaaatcatatgattaagattgattattcaaaaccaaagggaggtacatttaccatgaacagcaagctcttacaaccgaacggatttatgccctgggaaaagaacccggagtgcttccgtatcaataaggcaaagcctcacagcgatattattcctttccccacagtggaggatgccctttcctggaataaagaagcacgggatattacggatctgaacggaacctggaaattccgtttttttgaaaacccggatcaatgcgacgaagcttatccccagggcctggagtgccttatggatacacataactggggacatatccaggtgcctgccaactggcagctgcaggggtatgattatcctcagtacgtgaatgtgaaatatccatgggaaatgacggaggacattatgccgcctgagattcccaaagtctataatccggtaggaatttattcccgtacctttaccgcggataaggcggatggcggacggctgttcctgcggtttgaaggaattgaatcctgcggggaggtctatgtgaacggaagctttgtgggttacagcgaaggctctttcactcctgcggaatatgatataaccgaattcgtaaaggccggagaaaatcagctggttgtcaaggtgctgcgctggtgcgacggaagctggctggaggatcaggatttctggagactttccggtattttcagggatgtttacctgtattccctgccggaggtttatgtcagcgactggagggtggatgcccttctggacgaagattaccaggacggccttcttacggtagaggcagaggtggaaggaaatacggacggctgtctggtacagatggagctgtacagctccaagggacggcagataggggaaacggaagcggaaaatgtgactgatggaaaagccgtatttcacgtggaagtggatactccctggcagtggagtgcggaagcgcctgttctgtatacggtagtgctgcgcctgataagggatggacaggagacgatcctggcttcccgctgcggattccgtaccttcgaaatgaaggatggcctgatgatgctgaacaataaacgcatcattttcaaggggacaaaccgtcatgagttcggcgccgaatttggcagggcgattaccaaagaagcgatgcttgcagatgtgctcgcgatgaaacggaataatatcaacgcggtacgtacctcccattatcccaaccatccttactggtatgagctgtgtgacgaatacggactctacgttatcgatgaaaccaatctggaaacccatggaacatggacatacggcgttcctgaggatcagcagccggatgtgcttccgggaagcaatcccctctggacaggagcggtactggaccgtgtggcggatatgtattaccgggacagaaaccatccctgtgtgttgatctggtccctgggaaatgaatcctactgcggaaccaacttccgggaaatggcagatttcctccgggcacatgataaaaccaggctggttcattatgaaggacagcaccattgcccgggctatggggatgttacggatatcatttccaccatgtatactccggtatcggaatgggtgaaatacgcggaaggcaatccggaaaaaccggcaatcctttgtgaattcgcccatgccatgggtaattcctgcggcagcctggataaatacgcagaggcttttgataaataccccaagctgcagggcggctttatctgggatttcgtcgatcaggctatcttgaaaaaagatgaggacggcagggaatacctggggtacggcggtgatttcggggacgactatacggacggcattttctgcggaaacggcctgatgtttgccgatagaacggaaacgcccaaaataaaggaaacccggatctgctatcagaatattgcctttgaggatatagattgggaaaacggggaagtgactgtacacaataaatgtctgtttacggatttgaatgcctaccgtctggtatggagcctgtatctggatgaggagaagacggcggaaggagagctggaaaccgcctgtgaaccgggcgaaacagtgaagcttaagttgccgttaggcagactgccggagggcagcttcatggaagccttcctgaatatggaggtacagctgaaggaagacacctgctgggcgaaggccggctatgcggtagcaaagggacagttcattacaggaagccgtgagaagcttcaggacgggaaaaagaccggcggcagcctgaaggttacggaaaacttcagcactctgatcgtaaccggttctgattttgaataccgtttttccaaacgttccggagatttttacagcatccgcaggaacagcagggaatatctgaaggcgcctgtggaatgcaatttctggagagcgagtacggataacgacaggggaagcaagcagacctaccgctccatgatctggagatatgcgggagccaatgccgccaaatggacgaacaaaggggagataagccccgaagcggtggaaatagatatgaaatttatccttcccaccacatcccaggtggtgatggataccaaaataacaatacgccgggatggaagcatcttgttcgacaatacctataacggcggggaaaatcttccggatatgccggaagcagggcttatgttcattctgccggaaagctttgaccgtttccagtggcatggcaggggcgagcatgaaaattatattgacagaaaagcttccgcatttgtgggaacctatcaggcgaaggtgtcagagaggatggttccataccttatgcctcaggaatgcggaaatatgacaggtgtcagaagacttaccattgccggaaggaacgggggaagcctcaccttcacaggattcccggagatggaagccaacgtgcttccctatacgccggaggaaatggagcttgccgcgcatcagaaggatttaaagccctctgagaaaacggtggttcgtatcaattaccggcagaccggcgtgggcggagatgatacctggagcctgaatgccagggctcatgaagagttccggatcaaaggcgacgggacatatcattttgcctttgaagtaaagccggaatagagtggaattaaacgcagctaaaaagacagccatccgggttggaaatcccgaatggctgtctttgtcctttataggtaatgaaacgaaaccgctgcaaatcaagtcatggacgctttatatatttcatcaatggaacgctttaatacggcgttgaattcctcgtccgtctgctgtttctgcagccctgcggtaagggcgcgcgagaagctggctatcaggccatggttccttgccagccgctgattggcttctatctggctgtaaccgccggaaagggccaccacacggacaacatggggatcgtttatgagctccagatagaaatcatcaatggaaggaatggtgagcttgaacatcagccggacatccggatccaggctgctcagatgtgcaagcagttcttttttcaaaagcttctcactgttttccttatccggtataaagatatccacctcaggctccagaatcggcacaagccctgcctctgcgatacggcatccgatttcaaactgctgatccacgatctttttaataccataaggatcggcggccttgataaccgacctcattttggtgccgaaaatatgtctgtcattcgccctcttcagcagctcatccaggttgaggatgggcttcatgacacagacgccgttttcctgctccgcaaggcctttatccaccttcaggataggcaggatgcctttttcttcccacagataatcggcggtatatttcccttcgatctgacgatccatcgtgttttcgaaaagaatggcccccaggatatgttcggaggtaaaagccgggctggttataatcctcgtccgcatctcatggatgagatcgaacatttcttcatcgccgtgataggatccgtccggaattccatagagccggagagccttcggcgtacttccgccgctctgatccagtgcggcaataaatccgttacctttttgcatccgacagaattgtttctgatccatatatgctcccccttttctttggtgtgccggcaattttttaagaagcggcatgcctgccaggcaagtggcttccgggcatgattgccgatggttttctatagttatattatactacgatatgagggaaaatgctataaaaccgataattattacaacagtggaggttaccgctcagccatacccagtgccctatgtcttccaccgaccgggcggcccttctgctgcggatttccttcccggggagcctgtgtaccctgcaaaggccttctaaaaacgccggtccttagattgcgtcctgtgcaatcttagtaccgctgcgtttttagcagagtgaaagcgagtgcaagcactcgctatgtgcctgcgcagggtacacaggctccccgggaaggaaatccgcagcagaagggccgcccggccagcggaagacatagggcactgggtatggctgaacggtaacatagcggaaggccccgcaagtacgggaccttcactttttttccatattttaattgagcaacagaaccgcattacaatgcctgactaacacgatgctgtgttcccttcaatttgttattatcatatcctaaaaatgtgacaaaactatgtacactttcataagaaaaaataaaaaaataccgaaagaatttagaaatattttggaatgtgataatatatgttaaggttccggtccttacggcagcactgccttgtggttttgcctgccggaacagcctgccggggcgaagattgacaatgggcggggatggggctatactttttaaaattacatgtgtaggaaatgaaaggagcagaggatgaaggttattcgtgtttttggaaatataatatttatggcagcagccatatttttctgtttatgcatgtccattcggcccttatgcgcttccacagtcagcggggcagtgctggggagggcggtatcttccagggtactggatgaagtttataaggtatacccggaggttacctcggagcagatggaagaggtggaaaattttctggaggaaaaccaggccgtgaaagaactggcgggcgcttatctggatgtgatggccggttccgtaaaggacgggactccggtttctccggaagactacgaagcgctgatcggggaattgaaacaggatgtttttcctcagctgatggatgaaatgggcgatttgcttacagaagaggaaaaaaatgcgctgtatgaaggaattgacagccagagcgaaaaaataggacagattatggcgcagggggcggctgagattacggagcagtcttatcctcctgtggagacggcgcttgaactgtatggctttctggattctttttctgtgaaggcgctatctttgggtgtggttatcttaagcgggatcattgtacttgcgtcgggaagacgccgttacagagggcttttgtccctggcaagggatgggattgtttccggtatcatggtgggagcggttattccttttctggcaaatacggcggctcatgttctgacaaaccgcattttgggaagaacggcagagcttacgctgacgccattgttcttctatggagggattttctttgcgggaggattcgttttgctgattatgtattatgtggtccgtggccggagaagatagggacatgggcaataaagaagagtgaaaaaggacgggcggcgatatgctgttccgttcttttttcactctgtcagttaaagatttcattagtatcaccggcccctacgaaaaaagcagacgggcagcagtggtaaacaaaaagcagatgagaattccgcaaacagtgggtatcaaaaaagaaagaagggtccatttcaggcttcctgtttcctttttgatggtgaggcaggtagtggcacagggccaatgcatcagggagaacaaaatcgtgctcacagcggttatccaggtccagccgtttgcagtaaaaagctgcagcagctgcgcgccttctatttctatcagacttcctcccgccatataggtcatgatgatgatgggaacgacaatttcattggccggaagtcccagaagaaagccggtcaggatgcatccatccatccccagggctctggcaaagggatccagaaagccggtgagggaggtgagaagcgtggcctggttatccagatgcacgttggccaggatccagatgatcaggccggcaggagcagcagataccatggcgcgcccgaggacctttatagtacgatctacaatgcttcttataattacctttagtatctgcggtttccggtagggaggcatctccagggtgaaggaggatgggactcccttcaacagagtggctgacagcagcctggaaaccagaagggtcataaaaacgcccaggatgattatgcctaccagaatgcaggctcccaggaaagaaccgtaaaagcctcctgctcccccgatcaggaacagggtgatgatggaaatgatggtaggaaatcttccgttgcaggggacaaaattattggtaatgatggcaatgagccgttctctcggagaatctataatccggcatccggtaactccggcggcattgcatccgaaacccatgcacatagtaagggcctgtttcccgcaggcagagcatttcttaaaacaccggtcaagattaaacgctactctcggcagataaccaaaatcctccagcaaggtaaataacgggaagaaaatagccatcggcggcagcatgacggaaaccacccatgcgataacccggtaaatgccatgcagcagtacatcggtcagaagcccgggaatacccgccgcagcggccaaagaggcgaggcggtcttccagcccgaaaagaagatccgccagcagggcggaaggataattggcgcccgttatggtaatccagaaaatcccgagaaggagcagcagcataatgggaaagccggtcagcctgctagtaaaaatacggtccagccttcgatctgttttatcgcagccttcttccggatagaaaacaatcccccggcataaccgttcggcggtacgaacaaaagcggctgccagatcgtcatgaagctgttccctgctgattccccggtttctgagaaccgcatgaatctcctccagaaccccggtaatttccggttcggatgcgggatcaaaacccaggtacgcctttatggcggacaaaaggttttcgttggcatctagaagccgtgcggcaagccatcggggagagggaagggaggccgtctcatttccgtgtgcggcatacagcctttttatgcagggaatgaggtgggagagggcttcttccacatattccggatagacaacaagaggaaagctctgtttggcaggtgttgtggcaaccgtttcagtgtcgggagcggcaggcgggaaaagcatggcttccagggcccccagcagttcatccagccccttcctgcttcgtgctgtagttcctgttaccggtatatgcagacgggatgacagctgcggaagatcaagccggatttttttcctggcggcctcatccagcaggttcacacataaaaggaccggcctgccggattctatgatctgcagcaccaggttcaggttccgttccagacaggtggcgtcacataccacgataacggcatccggttcctggaaacagataaaatccctggcaacttcctcctctgcggagtgtgccatgagggaataacagcccggtatatccacaaatgtatagcagtgttcatggaaggtacaggttccctgggcgttcagtactgtttttccgggccagttgcccgtatgctgcttcattccggtcagtgcattgaaaattgtgcttttccctacatttggatttcctgctaaagcgatgatttcaggagagttatctgccatgggaagcctcctttttcaaaaggatatgtctggcatcttcctcacgcagagctatgactgcctcccgtatccggtatgcggtagggtcgccgagggggctgcgctggaggcaggctactgttgtccccggaatgaatcccatatcctgaaggcgtctgcgcatttctccctgggccgtcaactgagcgattatggcagaaaacccgggttccagccggggaagcgagaatgtatccgtcatatgtttcctccttgttttgccggaggactccagacggactgctgctggagcaggacgcaaagctgaagcggcaaaggcctccgacgtatcattccaatttaatatatgcagaagaaaaaaatgcgtgcttcctgccgggaaggggttggcaatttacgaaatataagataaagtaatagagaggatgcttttagaagagagggaaaaggtgttgaaaacaggaatcaaaggtttccgggaactgatggtaaccggagaaaatacggcctcagcccttggaagcggccggctttgtgtgcttgcgactccggcgcttgccggactggtggagcggacatgctgggagagtgtggaaccgctgctcgaagagggagagactactgtggggacagctttggcaataaaacatcttgcgcctaccccggtgggaatgaaggtgtggtgcgaaagccggctggtacaggcggacggaagacgcatggtttttcaggcggaggtttttgatgaaagcggaaagataggcgaaggcgagcatgaaagatttctcgtccgggcggaacgttttcagcaaaaagcagatgccaaaggaaacctgcaacagggaaaggagcaagaaattaatgggtaaggaaaagaagagaaaaaacattgtgctgctgatgacggatcagctgagaggggattgtatgggctgtgcgggccatccggatgtgaagacgccttatctggatacgctggcttccaaagggatccgttttcccaatgcgtattccgcatgtccttcctgtgtgccggccagagccgcgatgcatacggggctgactcaggaatcccacagacgggtgggatattcggacggtattccgtggaattacccgtcaactatggcgggagaactgacaaaagcaggatattatacccagtgtgtcgggaaaatgcatgtggatcccctgcgtaattatctgggcttctgtaatgtggagctgcatgacggttatcttcattattatcgggatcctgatatcccatacagagagaatcagaaacaggcggatgattattttcattggctgaagcaggaaaaaggaattgactgtgatgtgacggataccgggctggaatgtaattcatgggtggcaagaccatggatttatgaggaaaaataccatcccaccaactgggtgacggatcgttccattgatttcctgcgcagaagggatccggacatgcccttttttctttttgcctcctatcttcgtccgcatccgccgtttgatgcgcctcagtgctattttgacatgtacagcggaaaagaactgacgcctcccgcgatcggtgactggtgcgatgacgaagcgctgcgggaaagaggaaggatttttgattcggataccggcccgctggatccggagcttgtccggcagatgcagatcgggtactatgcctgcgtgactcatctggatcatcagatcgggcgtctgctgcaggcgctgatcgaaaataagctgtatgaggatacgattatcctctttgtatccgatcatggagagcttctgggagatcatcatctgttcaggaaaagccgtgcataccagggaagcagcaggattccgttcatcatttccggcggaggagctgctcagggaagagcaggaagagtcagccgggaactggtggaactccgggatgtcatgcctacggttctggaagcggcgggagtcgctgtcccggacagcgtggaaggtataagcctgtgggatatggtacagactgaaaacggctttgtggacagggaatatctgcacggagaacatgcgctgggagcggcatccagccattggatcgtcacccggctggagaaatacatctggtattcccagacaggggaagaacagtatttccgtattggtacggatgaaaatgagcttcataacctggttcatgatgagctttatcaggacagggtggttaaactgcgcgaactgctgatccatgagctggaaggaagagaagaaggctttgtgaaggacggcaggcttgtaacgggctgtgaacccattgtatggctgacgaaggacggaaggtgacagctcagacctgtatgagaactgacacgaggaaattcccgtttcccgaaagtacaatgaattgacaaccctttgagaaaatgatacattaaatttcagtgtatcagcattaaaataagaaaaatctgagaggtacaagaaaattatgcattggtctgacagaattgcgcaggaaattatcaggcgccgtcctgataaagaggaatatgtatgtgcagccggcatcagcccttccggctccatccatataggaaatttcagagatatcgcaaccagctattttgtggtaaaggcgttgagacgccagggaaagaaagccaggcttttgttttcctgggatgaatttgacagactccgtaaaatcccggtgaatgtagccaagcttccccgtcctgaaggtgagaagccctgggaagaatatatcggatacccttatgtggacgtgcccaatccctttgacgacggctgtcccaattatgcaaagcatttcgaagtggaatttgaagaagccatggagcgcttcggcatccacatggattaccgttatcaggcgcagatgaaccgttccgggaaatatgcggaatatgtgattcaggcgctgaagaagcggggagaaatttttgatatcctggacagcttccgtacacaggcagcccaggaaggtgagaaagaggcttattatccggtgagcatttactgccctcactgtaaaagggataccacaaagatcctttccctttccgaggactgcaccgttgcggaatatgagtgctcctgcggacataagggaacctttgatttcaccaaagactttaactgcaagcttgcctggaaaattgactggcccatgcgctggatgtatgagggcgtggattttgagccgggcggaaaggatcatgcaagcccgggcggcagctatgataccagccgtgtgatttcccagaagattttcggatatgaagcccctcttttccagggatatgagttcattggcatcaagggtgccaccggcaagatgtccggctcttcaggactgaacctgacaccggatacgctgctgaagctttatcagccggaaatgatcctgtggctgtatgccaagtccgagcctaccaaggcttttgatttctgctttgatgacggaatcctgcgccagtattttgaatttgacaagcaatacaatgattttatggacggaaaggctgatgaattccttaccaatgtaatggcgaactgcctgcaggaggatgaggaaggaacgtccgcttataagaagatagaaaccgtacctatgagccttcttgtgcagctgggatcagttgttgatttcaatgtccccatgttggagacggtattcgaaaaaatcgggcagccgttcacctacgatcagttcaaggacaggctggaacgtgcgaaatactggctggagcagtgctcaccggaaaacgtgaaccgtctgagaccgtacaggaactgggaggtttatgaagccctttccgaagaggaaaagaaggagatcgctcttcttcataattatatcaaaaagggcggctacagcctggatgagctcaaccaggaactgtatgcgatacccaagcaggtgatgggagatttggaggatgcgaaggaactgaagaagattcagggccagttcttcaagaatgtataccgtctcctcattgataaggaaaaagggccccgtctgtatctgttcctttatgcaatcgagcctgataaatatgtgaacctgcttgatttctcaacccctatgactgaggaagaaaagcagccccaggtgaaggaagagacggcggaagaagagtcctcaaagaagcaggtggttttgggagatccggatccggtagaacctgtccgcgatgaaatcaccattgatgatttcactaagatagacatgcgcgtatgtaagatcctgaagtgcgcagagatcagaaaatcccacagctgctacaagctcaccctgtttgacgggctgaaggagcgtgtgattgtatccagcattaagagctattacacaccggacgaaatggtgggaaagaagattattgtcattgccaatctgaagccggccaggtttgccggggtgaccagcgatggtatgcttttggcggctaccaataatgcctgcggctgccaggtaatctttgtggatgatatggtaccggaaggaacaagaatctgctgatgcgggaagaaatagtggaaagctccggaaatattgatttccggggctttccgcctttatggacgttaatggcagaacaaaaaatggaggaacgaatatgagatatccgtcttttttacagaaacagggaaccataggctttgtcgcgccgtcctttggctgtgccgaaccgccttataaaacggcctttctgcatgctcaggaaaaactggcagagtcaggatataagctggagctggggccgaactgctatgcccgggagggaataggaatcagcaatactcctgaaaagtgcggggaggaactgaatgacttcctgtgttcggataaaagtgatgtcctgatttcctgcggcggaggggaactgatgtgtgaagtcctggattatgtggattttgacaggatcaggaaggcagagcctaaatggtatatgggatattccgataataccaacctggtttttcttcttaccacactctgtgatacggcggcagtttacggaccctgcgccggttccttcggtatggaaccctggcatgagtccattcaggacgctctggatctgctccggggcaagaagcttgtcatgaaggggtacgatacatgggagaaggagcctttaaaatccgaagagaatccgctggttccgtatcatctgacggaaaaacgtatcctgcgctgcttcccggaaggagacagcagcttttcaggaagactgataggcggatgtatggactgccttgtaaatcttctgggaacctgttatgacagggtaggagactttacacggagatatgaagaggatggctttatctggttcctggaggcctgtgacctgaatgtgttttccatccgcagggcaatttggcagatgcagcatgcgggctggttttcccatgtgaagggctttcttatcggccgtcctctggtcttcgggcaggaaatgatgggactggatcagtaccatgcggtttatgatttgctgaaggaataccaggtcccggttatcatggatgtggatttggggcatctgccgccgatgatgccgctgattaacggaagttttgcttctgtaaccgtaaggggaaatgaactggaagtgaagatggaattgaaatagggagcggcatgaactctacgacgacgattcctatgtcaaaaacacctttgcagaagaattccggatagccccataaccaaagaactcccaaacacatgagggccgcataacacttaaccttaagaaacactcctggaacgtactccgcttcaaagtaaattaaacaagaaaaagctgaggccctttcaacaaaaaggcctcagcttttaaactttttcgttcaatacccaaaatacaaaacaccttactacttcattaaaggcgttccaaaccgtatcctgcgataaaatttctgaataataaccacaggaagactgacaaccaaatataaagtagaaagaatccctgcaagccctccgattaacataataataagcattccaatattcataatatccatccctcttttaatttaacatttattttttccagactcattttagcagtgagccataaaactgaaaaggttttacaaagatgcttaacacaatcctagcattgtattagcattttcttagcaggcatgtcgatagtgtccgcgggatttccgggtcgcccggtctgcatttccacccatcctttccggggggctgcggtgatgcaaggattcctgtaagggccgttataaatacgccggtcctaaggttgcgttctgtgcaaccttagtaccgctgcgtagttatccgagcgagagcgtgcccgcacaggaaccttgcatcaccgcagccccccggaaaggatgggtggaaatgcagaccgggcgacccggaaatcccgcggacactatcgacatgccgtggcccgctgtaaagaagcagcgggcccgtgactttcccgaaaagctgtgatatacttattaagaaaataaataccgtgtgtgagaacggaggaagtatggaacgagaagaggaagaaaagaaacattttgcagtccttattgacgcggataacatcagtgaaaaatacgcgtccagtatatttaatgaaatagcggattatggatatgcatcatatcgccgtatttacggaaactgggcaaaggggaacggctggaaggaggacaccctcctggagaactcgattaacccaatccagcagtttaattatacgataggaaaaaatgctacggatatggccatggtcattgatgccatggatatcctttattccggtaaggtggacggcttttgtctggttaccagtgacagtgattttaccaagctggccatgcgcctgagagaagagcagaaatatgtgatcggtatgggggaatccaagacccctctggcgctgaccaaggcctgcaacaagtttatccatctggatttgatatccggagaggtggaagataagagtacggagagcgtaaaggtaacagggacaggcagaagacagaaaacatcgactgtagaggaaaagcaggacagcactgttacccctatcagtgaaatagaggaatcaattatcacttttgtacaaaacaatgaaaataaaggtaagcctacctacctgggcgaggtggggagcagactttgcgataagttcatagaatttgatgccagaaattatggttataccaagctggtaaccttacttaaggacaaatgtcccaaacttgttatcaaacaggagggaacctcctaccagatcgaattaaaggagcagactgagcctgaaaatctggaaaaggaaatcatcgctttcttaaaacggaacggaggaaaagtggacaatctttccctggttctggagcagcttaagaaaaagcatcctaattttaatctcaacgattatggttacagcagaatatccagtttcctgcgcagctttgataaaattacggtacatggcaatgcgctgatgctgaaggaaacggttcataaaaaatgaagcaaagaaattaatctgccggatgttatttcaaaattgaagaaatcaatgttctatataaaatctgaatatacattgagtatatgtaagataaaaacaggaaaagagtcgggaaatatgaaatcccaggctcttttcctgttttttttaagatgaatttactattagaaaagataggtcaatacagcatagtttcgtgtcaactggaaggaggttttttccctggattagtagtaaaatataattattcttaagaaaaaacctgcagggtaacaaggataatatcaaaagaggaggaatggggtatgaagaagatttttgccattttaatgtctatgatgctgatttttacttttatcggctgttctggaacagaacagaaggaagaaggacaacaggatatgaaagtgacggactctgtacaggcagaaagtgaagaaaagaaagatactgtagtcgagaaagaagaaccagtgacattgagtcttacttttcattatgaagaatcttatgtacagcctattattgaagaatttgaaaagcttcatcccaatgtgactgtagagttccagttgaataaggatggagacgaagccttattgaccaaaattgtgggaggtggttccactgatgtaactttgatacccagcattatggcagcggaagatatgccgcagtattttgttgaattaggagatccggaggaattgagaaataaatatttttatggagattacatgcaggtgggtggaaaagtttatggatgccctatcggagttgtttatgaagggcttatgtacaatcagaatcttctggatacctattatgaaggtaaagtaccaatgacattagacgagctgatggaatgttgcggaattatgcatgacaatggaattacaggcttctgtaccaatgcaggatccacatggccgtgcagatactgggataatctggcgattaccatgtcagaaaatccagattatgctaatgagattgtttcagaaaaagaaccatggaaagagggcacttatttaagacaaacgggagaaatgttagcagatatgtccgaaaagggatggttggaaaaagatgtggtaacctcaaatctttttgattcctcattggtggatatggcacagggaaatattgcctttatgctgacaggatcttgggcgcttccgatgttgagggatgccgcagtggaattgggatatccgaaggaatctatgggatttgctccattcccttacaaaaataatgtgagtgcagataacccgctttatatgaggatttcacaggacctgttcatggcagttaacaaaaacagccaaaacgtagaattggctaaagaattgtgtgcctttttctgtgaaaggatttcactggcagttggtatgaatgaaataatgatagacggtggaaaaacccaggaagaattgaaaaatttgggtgatatggattatgtgaagttctatacttctcctgctaaggataccaggattcaggaaatgggtgcagcagcagggctggacgtatatcaatatgatggttttcttctagattatgttatcctgccgccaatgaacggaaaaaaggcagaatttgataagcttaacgatctttggaaaaagaattttgaataatcttccagtgagacaagcgcagaaaaggaatacggagaggggaagaggatgacagcaagttacagagagaaaaagaaagtacagaatttccgtcgtaagcgtaggaaacaggaatgtattaccctgataatttgggtgtgtcaaataaactgtgtatcacttgcagattattcgacacacctctttttttgaataggtatcagcattactgacaatactgcatgttagtggaataaattggtaaataaatttagtgaggttaagggatatgacatcaggatttaattatcaggaggaactttccaagtgcagtaccatggaggatatcacggggccaaacggacttgtacagcggatggtaaaggatgcgatcgaacagatccttcaaagcgagatcacagattatatcacagatgaaaaaagtaaggggaataccccgcagcgtaatggaacatcccctaaaaaagtaaagacttcttacggcagcattgacatcgatgtcccaagagtcagggaaggggaattcgaaccggaagttattaaaaagagggctgtgatcgaggaggggctggaagcacagatcatctctatgtatgcgaaggggatgactgttcgtgatatcgtatcccatgtccaggcactttacgggattgaattatccccggcctccgtgtccaatataacggataagatcatggaggaagcaagggagtggtacagccggaccctggatggtttttatccggtcgtatttctggatgctgtgcactataaagtccgtgaagaagggcggatcgtcacgaaggcatcctatgtcgctctggggatcaacgcggaaggccgaaaagacatcctggggatctggatcggtgaaaatgaaggtgccaaattctggctgaaggtatgtaatgaactgaaaaaccgtggagtgaaagatatcctaattgcctgtatcgatggcctgccgggatttccggatgcgatcaaaaccgtatttcctgaaacaaggatccagctatgcattatccatcaaatacggaacaccatgaaatatatagcctataaggattccaaggcatttatgaaggatctgaaacgggtatacggggccgaaagtgaggagatcgcattcaggaacctggaggcgatgaaggacagctggaagaagtatcgtgcggtggttgagaactggcagatgaaatgggaaaacctctccacctatttcagctatggggcacagatccgccgccttatctatacaacgaataccctggagggatttaaccggcagctgaggaaagtgacaaaaaataaagccgtttttcctaatgacgaagcactaaggaaaacgttgtatctgacaacgcgggatataacagaaaagtggtccatgccctatcgggattggggcgagacttatggacagttcatcatcgaattcggcgacagggcatccatcgcctgagagaacgatcactcttcctgagtggatcgcgcagggggccgtcccctcccatatcctcttgttaacgcaaaataccgcagatgcaggctttgttccggattgttattgaataaagcctgcagctacggtaataactatcaataagagaattgtgtggaaggagagtgggattatgacacatgatgcagcaacagcatacgcatgtgtagcatatcgagttatggagtatgatagagagccgttgacggaggaacagtttgaggtggtcctggaaatgttatttggattttacaatgaaagggagatcgaaaagatctatcagcaaaatatcgtatttggttccaatgatgccatcataaatgaagaaaaaataaagggaaaaatagaatagtattgccggaaggcggcaatactattcatagaaacaaacgacgtattttggaaaaaactgtcatgcaaacataggtaaaaccaaatcgcggagtgccgaaaaagggaaccgggtacataccaatttacgacaatacacagttatatagacagtctcgataatttttttaagcatacctcttcttttcctgttttacttcagtgtatatccagtactgtctatgttatattacagttttacagactggaggggaacgtcaggcagtcagcattttgtgggctgggcaaattatgttcatgtttttacaaatgagacttacagaaatgtatttaaaactgcgggatattatctggctgcaggagttctgcagcagataatatctttggcactggcagtacttttaagtaaaccagtgaaaggaaacagtatctttaaaggaatcattttcttcccatttattatgaatggtgtcgcagtagcattgacttatcgtattttttatcagccggatggagcattcgacgttctacttaatgcattaggatcaggagggctggtacggatttggcttagtaatcccggaactgttaactgggctctgggatatgtttttctttggaagaatgtgggatacagctttctgatttatctgggtacaatgcagtcaatatccaaggaatattatgatgctgccgctattgacggagcaggaacctggcggcagtttacagcaattacttttcctaacatgaaaatgattattggtctgatggccactttttctattgtaaactctatagcagtgtttgatattccatatatccttacatccggtaaaaatggaacaaatactttctcaaccacaatgctggaaactgcttttacatataataaatttggagaagcatgtgctatggctatagtgatgcttctgatagctggtttggtaatgattctccgtaattgtgcttttagggaggaaaaagatgtttactgatggcaaaagaaaaaaaataatattttcaatgttgaggtatttactgttgcttctgatagtattcagtatcttatatccaatattaggagtattttttggctcatttaaaacaaagattgaatttcttagtacaaacggtattacaccaccgaagaattggacaaattttgaaaattataaagtggtattttctcagggacaaattcttactggctttaaaaacactgtagtaataattgtattcgcctgtgttacatctacactatttaatactatggtagcatattgtttctcaaggtttgaatttaaaggaaaagcgatattggataagatctatctgctggcttcatttgtccccggaacaatagttcatttgataatttttaaggattttgtgagaattggccttacagatcatctcagcagtattgtaatactttattcaggggtagatattgtaagtttgtatttatataaacagtatttgagccagatacctttttctattgatgaatcagctatgatggaaggaagctcttttattggtatatattttaaaattttacttcccatgctgaaacccgcggtggtgaccgcttgtattatcaaaactacatatatctataatgatttttatacatcatatctatatttaagttcaacccaaaaaggagttatgtcaacagtattatataggtttatcggaccatacagtgcacagtggagtgtgattgcggctggaattatcctggtaacgatgcctgtatttctaacatttatttttgctcagaagtatatttataaaggcttttctgatggcgcagtaaaagaataatagaacaaaaacaggaaagagattggtcggaaaatgggaaaaaagataaatatcaaagatttgggtgcgagggaaaatacactctgtacaaaagaaatccaaaaagctgttgatcttatagatgaggctggtggaggaaccgtaatcattccgtcaggagtatatttatccggaacaatacatttgaaaaatacttctctatatttggaaagaggagctgttctgaagggatcttcaaatataaatgattattatgaaaatggattccttcacaatgaaatgaaaaaaacaatatccctgctgtatgctgaaaatcaggaaaatatcaatatatatggagaaggaagtatcgatctgagttcagatgctttttttgatatggctaaaagggaagtccctgattacggcagggagttcagtgaagaacaaatagaggaatgtacggctacataccaatacagagtaacacaacctttgttttttaataaatgccatcatctgtgtcttaaagaaattaaaattctgaattctcccagttggactgtgtcttttaatgactgtacagatattcgtgtggaagctttatacataaataacgatttacggataccaaatgatgacggacttcatttttgtggctgcaaagaagtatttattcatggctgcaatatttcctgtggtgatgattgtattgcgttgacttccgtattggactgggaaaaaccctgcgaaaattttgtaatatctgactgtattctacgttcctgttccaaaacaattgtattaggatatatgcacggaataatccgtaatgtgacaatcagtaactgtattgtgaaggatagcaacagggggttctgcattatgtgcagtagcaggacagggctggtggaacatgtcctggttgaaaatatgcggcttgaaaccagggtacgggcaggaaattggtgggggaatggtgaacctatttgcatttttgcattatatcataataatgattcctactgcaatccggttcctgacagagatttgtctgtgaatatacgtgatatacaactaaagaatatcagctgtctggcagaaaatgcagttgcgatagtcggagaagcaggaaatgtaaaagatatatctattgatggtatttattatgaaaaaaggaggagtaagaacgtttatctaaaaggtgagaaaaaaatagacgtgagcccgagtgaagcacagatatgcctcccggagggggaagagcaatactggctgcttcttcaggagtgtgagaatattaaggtgagtaatatacgaataaaaagtttcgaaggaaaggaattgaaaagtgcggtaatcaggtgcaaacatgcggaattgtttccaaattaatgctgattccatagagtgaatatttctgttaaagtaaaagatgtaagaatgctgctttacacgagaaatggttaaaggagagactatggaaataatacagtggacattgccggaatgcgaacaagagagtggtgcggggtatgcctttaacgcaaatgtaagagaaacctctcctttacatacacatgatttttatgagatattttatgtgaataaagggaaagctattcattgtgtcaatggtgagcgtattgtggtttctagtggtgcttttgttttcattcgtccatgggatgttcatagttatgattctttaaattattcggaattccaaatgacaagcataggcttcacctgtgatgaagcagcagagggatttcgatggagtcagtttcctctatcaatggtaaatgttccaaaacttcctccgcatgtaatgctgaatggagctgaaaaaacggaatttgagaataagcttaaaggaattgagagtcatcctcgtggaatggaacggaaacggtacttccattctgttttcccgttttttatttatatactctgtaacaaaatcagacagacggaaacaaaacagcttcaggttatgcctccatggctttctgagttaatagaacagatgagtcagacagaaaattttgtgcagggtttgcccagactattggagtgttccagctattcccatgagtatattattcgtatatttcggaaatatctgcatatgacaccaacagaattcatcaatttgagaaggattaattatgctatgggactggtggttcagtaaaaatatcatataactgatatctgctatatgtcgggggttaataatctgagccatttttatgctatatttaagaagcagactggctatacacctaatgaatatttaaaggtatatggggataatcttgaggaggaaaggtgaactttggataaggaaatactgctgcaaaagtgtctggaaagggctgtagaggaagaagaaattgccggtggttgtattttagtaaacagagaaggacaggagatatgttatctggaaagtggatgggctaatagagaagaaaggcgcccaataagccgtaatacaatttatcatcttttttcaatgagcaagccgattactgctgcagctgtcatgatacttttggaagagggagtcattgatttatatgagccggtttcccgctatgttccaagcttcggcagacaatcagttatggaaggggacgaaatagtaccagtacaaaaacagatgattataaaagatcttctttctatgacatcaggattaacatatccgggccaattaaaccgtgcagagcttgagacaggaaatgtttatgcaaaacttgaggaagagatgaaatccggtggagtattcaccactaagcgttttgcggatgaaataggcggctgtgttcttgcttttcagccgggagaatcctggcagtatggagtgtctgcagatattctgggggcagtggtagaggccgcttccggaatacgttttggagaatttctggaaaaaagattatttggcccattaggaatggaagatacgggatttttccttccgtatgaaaaaagagagcggcttgcgaccgtatatgaatcggtacaggaacagaagctgaaaccttatgagcaggatcatttaggaataaggatatcggcttgtcctaatccatttgaatctggcggagcgggattgctatctaccgcggatgactatttccgttttgcggatatgctattgaatggaggaaaaaatggggatattaggattttggaagaagaaactgttcgtttttttaccggatgcggtctcgatagtaaaaggcaggaaagcttcagccaatggtttggactggacggacatacctatggaaatttgatgcgtatactgacggacagaaagctggcagggattctgggaagtgcaggagaatatggatgggatggctggcttggaacatattttgttaatgatcctgtcagaaagattactttgatttttatgacacagaaaaaggattttggcaccagtaatttaactagaaaaataaaaaatatagtattcagctgaagaatgaaagtacatactaagtggccgaagcagttctgctccggctcttttcttttgctatcttgacaccgcagtacacagtctgtaaaatgaatctgtacgtttgtaaaaaaagaaattcaatactcctgcggggagctgcggcagaattgatacgtgaacagtcgtcagggacaagctggtcccgcctgatctatctggagacgtcatgttcgcgagaataaagagtaaacaggaatgaataataattgtgacatcatcaccagaatcaaccaaaagtattccgggatgagcaaagggcataaaaagattgcttcctatataatggagcattatgatcaggcggcgtttatgacggcggcaaggctgggggaggagttgcaggtcagtgaatccacggtggtacgctttgcggcaggaattggctatgagggatatccaagcatgcaggcggcgcttgcctcctgggtgaagagtaagctgaacacggtcggacaggtaggagccaggtatggccgaagcactcagtcggaggtgctcagcagtgtgctgcagagcgatatggagaatatccgctgtaccatggaagaactggacaccgccgcttttcagaccgcagttgatattatacttgaagccaggaacatatatatagtaggaatacgaagttgtgctccgctggcggaatttttaagcttttacctgaatatgatccgggggaatatcgtgcagctgaaaaccacaagcctgagtgaggtttttgagcagatgctgcgtatcgggaaagaagatgctattataggaatcagttttccgcgctattccatgcgcacgctgaaggcgatggaatttgccaatgacagaaatgcaagagttatcacaataacggacagtgttcattcccctatgaatctttattcttcctgtaatcttctggccaggagcaacatggtttccattgtggattccctggcggccccgctgagcctgattaatgcccttgtggtggctctgtgcctgaaaaggccggatacggtaaaggaaagcctggaatcactggaaggcgcatggaataattatcaggtttatgtcaatgatgaaattaattttatagatgaagataccattctcgccatgccttccatagaaggcagccgccgtaagccggatgcgtccctgacggagaaacagaagggttgaaggaaatactgattcaccctccggtaataaatatatgataaaaaagcatgcggcggatgccgcagatgggagcaaatcatgagcagggttttggtagtgggcggaggagccgcggggatgatggcggcgctggcagcagccggaaaaggccacagggtcaccctctttgaaaaaaatgaaaagctgggtaagaaaatttatattacaggcaagggacggtgcaatgttaccaatgcctgtgaaccacaggaattgtttgacaatgtggtcagcaattccaagtttttgtacagcgctttctatggttttgataataatgccgtgcagcagttttttgaaacccatggctgtcccctgaaaacggagagaggaaaccgcgtgtttccggtatcggatcattcctctgatgtaatccgggccctgtcaggagcgctggaaaaagcgggcgtagagatacgtctttatacgccggttaaaaaacttctcacagaaaaagcaggagaagaaggttccttaaggataaagggagttaagcttttgtccggagaagaggtaaaaggggatgcggtggttcttgcctgcggcgggctgtcctatcaggctaccggctccaccggagacgggtaccgcatggcacaggagactggtcatacactcgtatcctgtaaaccatccctcgtcccttttcacataaaagaagaatggtgcaggcagctgcaggggcttgctttgaaaaatgtaaacgcctctttatatatagaaggaaaagaaatttatgaaggcttcggggaaatgctttttacccattttggtgtgagcggcccgctgattttaagtgccagcagctattatcagacggcggcggaaaagctgagaaggaagaaagaaaagcaggccggaaaaacggggaaaacggcggaaaacatggggagagaagcgcctgcgctcctgaagctggatttaaagcctgcgctttccgcagaacagctggataaacggatcctccgggattttgaagataataagaataaacagttcaaaaatgcagtggacggtcttttcccggcccggcttgttccggtaatgattcagctttcagggatcaacccggaaaagaaggttcatgaaataacgagagaagaaagaaaatttttcatagaatgcatcaagggacttaccctgacggtgacgggtacaaggggctttgaagaagcgatcataacccggggcggcattaaagtgaaggaagtgaatccttccaccatggaatcaaaactggtgtccggcctgtacctggcaggggaaatgctggatctggatgcgctgacaggaggctttaacctgcagattgcctggtcgaccgggcatctggcgggagcgagtatccccttataaattgaaaggagcatctgccgtacttaggcgggatgcaggaacaggagcggatatgagttataatattgctattgacggaccggcaggagccggaaaaagtacgattgccaaacagcttgcgaagaagctgggatatgtttatgtggataccggagccatgtaccgggcgattgctctgtacctgctccgtgaaaaggtgaagcctgatgatacggaggctgtcagcaatacctgtacaggagcggaagtcactcttatttatcaggacggggaacaggccgtgcttttgaacggggaaaatgtgaacggctttatccggacggaggaagtgggaaacatggcttccagggcttctgctgttccggcggtacgggaaaggctgctgcagcttcagcgggatctggcctccagtgaaaatgtgattatggatggcagggacatcggtacctgcgtgcttcccaatgctgatgtgaagatttttctgacggcaaacagcgcggtaagggcgaagcgcagatatgaggagcttctggccaagggaacgccggaagcctttgaaaaaattgaaaaggatattatcgaacgggatgccagggacagaaaccgggaaattgctcccctgcgccaggctgaggatgcatatctggtggatacctccgatatggatatccctcaggtggttgataccattctggaaatctgccggcagaaaggatgcagataatatggaagtgattcttgcggaaagcgccggcttctgcttcggcgtgaagcgggctgttgataaggtctatgaacagattgcgtcgggtaagaagatttatacctatggtccgattatacacaatgaatttgtcgtgcaggatttggaaaaaaagggagtgcaggtgattgaatccgaggaggagctggataagctcacagagggtactgtggttatccgttcgcatggcgttcccaaatctatctgtgaaaaaattgaaaaacagggactggagtgtgtggacgccacctgccctttcgtgaaaagaattcataaaattgtagaaaaagaaagtgcggccggctgtcggattgtgattatcggaaacgcgggacacccggaagtagagggaatccagggctggtcactgacgcctgcggctgttgtggagtcggaaaaagaggcccgggaattcgtggcggaaccgggaaaaaagctatgtattgtgtcacagacgacatttaactacaataaatttcaagaattagttgaaatttttctaaaaaaaggttatgatattagtgttgtgaatactatctgtaacgcaactgaggagagacaaactgaggcaaaggatattgcagcgaaggtcgatgcaatgattgttatcggtgggaagcacagttccaatacaagaaaactgtatgaaatatgctgcagggaatgtgctcacacctgtttgatacagacactggatgacttgcatttagaactacccaaagctgtccgcctggtgggtattacagccggagcgtctaccccgaataaattaatcgaggaggttcaaaattatgtcagaattaacttttgaacaaatgttggaggaatcattaaaaactatacacgcgggagaggtagtcgaaggtacagttatcgatgttaagcctgaagaagtgatccttaacatcggatacaagtcggatggtgttcttacaaggaacgaatacaccaacgatcccagcgtggacatgacagcagtcgtaaagcctggtgacaagatggaagtaaaggtgctgaaggttaatgacggagaaggacaggttatcctttcctacaagcgtcttgctgccgacagaggaaacaagagaatcgaagaagcttataataaccacgaagtgcttaccgcaaaggttacccaggtactggacggcggcttaagcgtagtagtggaggaagttagaattttcatccctgcaagccttgtatccgatacttatgaaaaggatctgaacaaatatgcaggacaggatattgaattcgtaatcagcgagtacaatcctaagagaagaagatatatcggcgaccgcaagcagcttatcgttgctaagaaagctgaaatgcagaaggaacttctggaaagaatccatgaaggcgatgttgttgaaggaaccgttaagaatgtaacggatttcggcgcttttatcgatttgggcggtgcagacggactgcttcatatttcagagatgtcctggggaagagtggagcatcctaagaaagtattcaaagttggggatcaggttactgttcagattaaagaaatcaacggcaacaagattgcactcagcatgaaatttgatgatgcgaatccctggaagaatgctgctgagaaatatgcggtaggaaatgtggtaaccggtaaagtggcaagaatgactgacttcggtgcttttgtagaactggagcccggaatcgatgctcttcttcatgtatcccagatcgcaaaagaacatgtggacaagccttccgatgttcttaagacaggggaagaaatcaatgccaaggttgttgatttcaatgaagaagacaagaaaatcagcctgagcatcaaagcaatgcttgctcccgaacccaaggaagtaaaggaagaggagtttgtacagaaagaatctgatgaagatgtggtttctgtagatattgatgccgttattgctaagcagaacgcagaagaagattctgctgaataattaagaagttttgtgggcggcataatttgctgtttatgggatgcggtatattccgcatcccttttttcaggcatccttttggggatgaggataatatttaccatttgcggtattatagaaagaaaagtccgaagccggcagagggggacggctgcgcgacagagactggtgttccatccggcagcaatagtgagcggatggaacacaggcttcttgactaacaatttcggaggaagacgatgaaaaagaaggttctgtatgttgcagcagtactggcagctttgatttttatctggctgggaaaggaagacaacaagccgctcgtgctcaagggcacggatttgaatcagacggcgggaatcagtgattatacgggtttgattgccatagatgaatcggcggcgtattacggcatgtttgcctatacggatgattatgtattgaataaggggacttataccatacgccctgaatattccaatacgtcatctgataatattattgaagtgtgggacaacggaacgaaggtggcccaatggagtctggaaagcacggatggagtgaagactgccagagattatacctttactctggataaggattctcagcagcttcatatccgcatttactatcagggagtgggaagcctgatactgaacaccatgtctctgattccccagggggctttttaccgggatgccccgtaccttatggttctggtaatccttttggctgtgtccggggtgttccttgcgtcctacgaaaaaaagcatccttccagccgggaaagaaaagttaccttcctgattctggcgggtctttgcctgtattcgtccatgccgctgtttatccaggcctttgcccaggcggatgatgtatgctatcatctgcttcgcatcgaagggctgaaggatggtatgctggacgggcagttcccggtggttattttcccggaagcgctggcagggaacggttatctgaacagcatgtatccgtatctcttcctgtatatcccggctttcctgcggctgctgggggtatctcttgccctgtcctataagacgcttattttcctggccaatatcgctacggttgcggttatttataaggtgctgaagtccatgactccttcccgttatgcatgtattctgggaacggccctgtatatactgctgccttaccgctttaccaatatttatgcgaggggcgctttgggtgaaacgctggcgctgactttcctgccgctcataatcgggggcttttaccatgtgctcatggcggataagaaaaaatggccctggcttgtcataggctttaccggggtaatagagagccatgtgctcagtacggcgaccatggctgtcatattcagtctgtgctgtcttttgtttatccgcgatctccttcaggataagagatggctggagatggtgaaggcagcggctctgaccgtacttctgaacctgtggttcctggttcccttcctctatttcttcctgaaggaaaacctgtaccagaaagccctggactggagcggtttttcggaatactccatcaacgcttccttcctggcggataccttccataccaacgattatcgtttcctgtctctgggacttccggttctgggctgtgccgggatatgtgtcctgaagctggtatgtgaaaagtcggaagagaaaaatggaaaaagagataaattcctgacatatctttttggaggagcctgtgtgctgacctttttagtgacagggtattttggcagtaagacgctgaaggaattaatacctgccattgagccggttctgcgtaccatacagttcccctggagactgctggcgcctgccggaatcctgtttatttttgcaggggttatatggctgtcggaatccgaggtattaaaaccgtatcggaatctggtatttgcgttcctggtgggggtaaatctgctgacctgcctgaatcagccttataatcagaataattttgcctataaggattatgatgataccacaaccgtagggcatcaggataaaataatcggcataccgaaatccgacgcgacggttatttatccgtatgaatggcggattgacgcgctgatggatgataagctgacttctgatctgcagctatccgacgccgaaaaggtcacagtggaaaattatgaaaagaagggaacgcacggaacccttacctaccggacatcgggggaagggcagtatgtggatttccctctccagaaatatctgggttatgcggcggaagatgaaaacggtgaaaaactggaaatatcctacggaaataattatcgtatacgcgttatgcttaccagcgacggggaaagccataccgtcagtgtgagataccgtcagccggtgatattccgcttatcccaggcagtatctttgctcacactgctgttctgcatcgctcttgcggtaaggaaaaaagaacgcctggccagacgcttcagacatgtctgaaatgttatcggtgatcggaaaaaacggaatgcgttaacgcattccgttcagaatatgatgagcatataaagacagcctgccgctgtcattgaggaaagcttcttccagaaggaaaaagctttccttttcttttacctccctgcggaaagcgggagtaaaaaggtcgtcctgggaaggaagaagatgctggggaaggaaatccccttcctttttcgtataacaggtggccggtgtggctggcacacgatgggccttgtccacgtagaccgcaacggatttatggatggccttgtcttcctccgggagataagaataatttttataatccggataatagaactttaattctccggaatataccggaattttcaggacgccggagtcctcctttgcggaaaaaaagcagcctcctgcatggagtgcgagtggaacgggaagaaaaaccggaagctgaagataaaggagcagctccttctgcctgtttccctcataatccgtaccgatatccagttccgccctggcattttccggatgcatggcaaataaagcgggataagagaggatggatacaacagagagcattcccctgagatcatccgcattatgcagcagcagaacttccagcagacggtgatcccgttcctggcggtagaccttataaagctcgatgagctggcctccgttaaaaggatcctcccggttgagccccaggaattcttccagggatttctgcttgcagttggagagcttaagcagatttttaaaaggtgaaatctgccggtagatatccgtctgttccatttctgcaaaggatgcggttaaaccgtactttttgcatttggcctgaagaaaaggaatatcaaaggtcgtcccgttaaaatgtaccagttttttatagggaaccgaaaattgcaggaaagcgtccagaatggcttcctcctcagccgtattttctgcaaaccattggtgcagtgtccactttttatcctcaattacagcggctccgatcagataaacggaagcgtttttgggagaaagtcctgtggtttcgatgtcaaaaaacaggatatttccatcttttcccagaaattgccgtatggcattttcgtttgttgtatgtagggtctgaattcgtgttttcatacaattaatatagcatattttttgatttttatgtagtaatttgatgaaaattaaggtatgattatgttatgccttgttcccgggttgacggcggaaataacgctatttggttaacgggcgggaaaaacatattacagaaaagagggatagctaaatggctaaggcgaagttaacgtttatgggcggcatccatccttacgacggtaaggagctttccaaggataaacccatgaaagctgttttgccaaagggggatctggtgtttccgttgtcccagcatatcggtgcgcctgccaggcctgttgtggcaaaaggagaccgtgttctggccggacagaaaatcggagaagcggccggctttgtatctgcggcagttttcagtaccgtatcaggtacggtgaagtcaattgaaccccggcgtgttttcttatgtgtgataaagaagtaatagaagtgtaaaaaattttgccgttcctatccggcacttagctcttgtgtcggataggtcgggcggttattcgggcaagtccaccttgccaacaaaagaataataaatctcaatgtcctgtctgcgggtcttgttctcgtcatagctgcactcatgtacaacgattttctctacaaactcccgaaacaaagtaggggtaagttcttcaaagctggtatgccgccggacaacattcataaacttttctgcgttcacagtggcttcctgtgctttggaaagctccgcttggatagcggcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcctttttcttggcggcgttcctgcgtttgcccccgtcctcgttctgctcaattaagagcttcataaaccgggcttcatgctttgccgcatagcttgtcactttccgcagattggagagtacaccagcggtcaagaggtcggtgcggataaagtgtgccgtacagtcatgggtgcgtttcttgtagttgccgcagatataacagtcctgcttgcgcttgtccgtctggtatcgctgctggtacatgacgctgccgcagtccgcacagaacagtatgccggagaacaagcccacttcatcatagcggttggggcgtttgcgctgcttgcgaagttcctgcacccgttcccatgtctgggtgtctatgataggctcgtggtggttctcgaaaatcacttgcttctccgggggattttctacgctgtgcttgactttgtaagagagcttttctgtcttgaaatttaccagacagcctgtgtattcccggttttcaaggatatgcacaacggtattggtcgcccacttgcactcatagccggggtggtagcggcgggtgctgcccgtcctgcggtattccagcgtccccggcgtggggatctgctgctctgtgagcatacgggctatcttggtcggaccattcccggcaaggcagaggttgtatatctgcttgactacgggtgcagcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaaatcattgtcgccctgtgcgctgtccactccgtcattgatagcgatgaagcggacacctttctgtgggaaaatcatttccgtatacattcccacttgcaggtagtttcgccctaacctcgacatatcctttacgataactgtcccgacttttccggcttcaatgtccgcaagcatggcttggaaaccgggtctttgaaagttcgcaccagaataaccgtcgtccgtgtaccagcgcagattggaaaagccgttctgctttgcataggtttcaagaatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggtggctgtctgtatagcggcaaaagcgtcaaatctgcttctttatggtcggtcaaatcgccgttttttgtgtagcagatgattgggattgcatagtagaaaaactcttgttcttatggtaaaatggagctaatcaatacaagggggtgtgacaatgaaagggtttgtccgtaacaatcagtacctttctctttgtggtctaaattgtaaattatgtcctatgaatttggcagggcattgttccggttgtggcgttgataatcaaagttgtaaaatcgcaaagtgcagtattgaacatgggaaaatcgaatattgctttcagtgtaccagcttcccttgtgacaaatacgctcatatagatgattttgattcttttataactcatcataatcaaatgaatgacatggaaaaagccagccagatagggattcccgcctataatgctgaacaggaagaaaagcgcaaattattggatttcctcttgtcacactataatgacgggcgcagaaaaaatctattctgtgttgcagtcaatctcttaacgattaaagaaattgaaaatatcttgcaaacagttaaatccgataaggattttcaaagtatggggaagaaagaacaggcttctgttatcgcaaaactgttgcaggatatagctgttccaaaaggcattgagttgaaacttcggaaaaaataaagttgttactgatattccagcggtcatgctccccggcgtgaccgcttttccatgtcatcacttatgcgctgaacggtggcgtatgtccggcagcagtttccgcttccagcactttcatcatcttgtcggctgcggtgtcggttgcgccctgcttgaagaagccggaaacggtaaggacggagttgcccatgcggatttccgtcacacagtccgggcggcggtctgttttggtggtgcttgtctgtttcgtttctgtcataggctctccttgcgctgcttcatcagttgctttaagcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctgtaaacctgttccagcccgtattctgtccctcgctccataccgaaatcatcaagtatcagcagggggtagctgcaaatgcgggaaatatattcgttcctgctctcaaagctggcggcaaggtcattgagtatcgttgcaaagtttgtcatgcgaacggcaacctctttttccataagggcgttggcgatacaggcggcaaggtagctttttcctgtccccacgccaccccaaaacaggtagccgatattttcagcctgcatggtttcccagctctccacataaaagcgggcggtttcggtctgcgggtttctgccgttgtcatgctcaaatgtccagttccgcatagcagggtcggtaaagccccggcgtttcaagtcctccactttttcaaggtgcttctgtctgctttcagcggcttcccgtttttcacgggctgcccgctggcagtcgcactctgccgggtgtcggtcatgccctaaccattgggcggtttcttttgaaaagtaggcttcttttggcgtatggcacttgccgcagtataaaagcccgtcctcgcctgtgtagtcctccgcttcggcggtagtggttgtaatgtccgtaatcatagcttcaatctcgtttttcataagctctcgccctccttgcatgaataatcgggtatgccctgtttcggggcagccttgcctttggcagcgtcctcctgcgcccacttgtaaatggtggctgcatggctatggtactgctttccggtggaagcgatatggcaggaaagccggtcaatataatactcccacttgtcgggcagctctgttttcagcccggaaagctccgtatcggtcagtatcacattgttgtatctgccataagcggcgggggcggggtgtcccgtttctccctctctctctttttctatctctttctctaactctatctctatctctggtggacgaatgtcggacaaatgtccgccttttgtccggggcggtaaaagtgccttgttttccagccttgcagcccgttttctctcggcttcggtagaggattgtcctatcatcagctcaatgtcggtcatatagaaagccccgctgtcaagctgctccacaagccccaactgccggaaaatctctaaagccctctcaaccgtccctatctggtggcgggtcagtgtcgctatcatctgcgctgtgtaggggatatgctcgtcaagctgcaatttcccgccgtttttcagcgattttaagtacagcttcaagaggatattggaatataaaatcccgtctttcatatcttccagcagcacaatggagtcgctgtcaaaaaagttctctttcaacttgaggtagtaatacttgcggttatctgccattgtccccgtcctcctttttccggcgtttggagtagtagcgggggcagagtatgacaaccgcccggaagctctgcttacagctatgggtacagccccggcagaggtcgttgtatgtgatacggtcgcaggtggtattcccgactttcacttgccgcaggaaaaaagaccattccagccgccgtttcttgctcattcttggcatgggtgcgctcctttctgccgtttccgctggtgtggcggtatcggcggtaattctgtatcatctcggtatcattttcggggtttttctgccctgtaagcccgtcaaaaaatcctttggtattggggatagggtacggggcagcccccttgttctgtatgggttcgggtacattttggggtggtttttatcgctcctgttcctgccttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcagggatttatagctcggcagcttggaaatgccgttctctctgaaataacgggcggctgcgtctgctatgataaagtcgctttcgtgcttctgacggtaggctgcttttgctttggcgtttttctgctgtttcagcccgtcccggacagggcgggtcttggaataggcaagcacctgccgttgcagctcctttttcccgtttagcgtcttttccacctgctttagctctgcaaggctttcctgcatggcggtataagcggcagaacaggcttcgtccagttcctccggggaagaaaatccatactgctgataggcggtaacggtagctgccatttgctttaggttgtgctttgccgcccagcggtcatagcccacgccttttccctcggctcgctttgttgcccggtcaaccatgcgctgaataccgtcctttttcggggtggtttgaacagcttttttgccctgcaaacgctcccttatgctgcgagggtattcgggtacggctgcggtctgcttggcggctctgtgggcgttctgttccaaaagggcaagaacggcagtgcggtcaaaatcatcgccaagcttgcgggcggtaatgggctttgtcctgtccggcgtgaggtaggatagccgccctcggctctccttgacagttacgccctgttgcaagagaacggcggcgaactcgtcatagctggcggcagaggacagcgcggcgcgtatggtctgccgcaatttttccttgtctgtttcaaacttcgtgggcttggctggctgttctccggctggcaaggcggcagcttccttgtccagctttgcctgtcctttccgctgcgcccaatactcacgctcggtaatgcggttcttgctgccatgcaaaaggtcgatttgatagagattttcccggtggcacagttccatgacttcggctttgaagtattccatcgctgcgtctgtgcagcggtgtttgcacccggcgcgggtgtctgccggtctgtccatgtagggcaggaacggaacttccgctatccgcagagaattgataacaatatgcacatggatattgccgctgtgattgtgtccgtccgggtgggtgcagacaatggcttggtgtccgggaaactgtttccggcaaaattcctcgcccagcgcctgcgcccggtctacggtcaagccgttgtctactgcgtcccgtgggtcaaagctgataatgtagtggtggcttttcacatcttcccgcttctggtttttcccatagcggagattggagcgcatacaggcaacggcaaaatcctcgccgccgcagttcagcgttgctattcggtagtcctcccggagcatgagccgcccgctttcatcaagggtgggcttcatggtaaactcatcatgttcaaaggtgaggtactgctcggctgcgccataatccgcatttttagagctgatatgtttgaatgttgccaacagcgtcacctacctttcgcaagacttcaaacttcaaggcggcaaggtcagaaatggcggcgcggacttcaacggacagggcgttgtatggtgtgccgtactcattgagggcgcgggcaatctgattgaggttgccgccgatttttccgtattcagcggtcagcctgccaacggcggacagcagttcatcattgaccggggaaacggtaacgatggggcgaatggtcgcccgtgtaatggcttgccggataaactcggcttggctcatgtcatagtgtttcagccgctcggtgaagtcggcatattcttcctcggtcatgcgggttttgaccacatggctgcggtggggcgtgttgtattttttcttcaagcgttgacctcctttctcgcccgacagggcgcatgagcagggtttggggaaggcactccccaacaagatttaccaaaggggaaaaaccgcagatatgcggattttggcaccgtggtagaatcttgctctaagaaactgccagactgccgttcacttcctactgccactttttcagaaaatcgcaaccaacttttttataaaaggctaccggattgccctcacttgctactgccactttttcgggaaatctataaccagcttttttataaaaggctgcaggctggcattctcccccttactccctacaaaccacaaaagagcagaatggacgaactttccggcaagaacttttccggcggctcggtctttcccgacaataaggcgtttcggaagctgcatttggcccgctgtctgaaaaaaacggcagccttttttgacttcactatctaatacggaacttttggaaatttgccaaaaatgggcgcaaaaaaagcagcaaatctttttcggatttactgctttgtgtgccgctgcggggcggcgggatattcagtttttatgttatcggtcaagccggaacttgaacaggctttcaatcagctttgttctgatgtaatcctccatatcagaattataatagccgttcattttggagaaatagcggatatatccggcatagcggtcaaggacagcctgtatcgctatggggtcgtcctcatgtgcctttattatcgtgtcataggggagaagtcggttactcatgggacaacacctccatttcctttttcagccgcttcaaggcaagctgaatatgccgcccgattgtgctgcgtgtccagccgctttgttctccgatttctttctgcgtcaagtgctggaagtaatacaaaaagatttcttcctgcgtctgttccggcaatcgggcaagagcagccacaagggagcagctatctaaaaatatcgtctgcccccggacagagaacggataagtttcgccatagtccggcacttgaaaatactcgtctgtggtgcttagtgggacaaacttttcttcggtcaaatattcaagggagatttcccgtttccacctcgccgccagcatacgggcagcgtcaaaggacgcatgacgaataacaatccggcaataggtatcatgggtatagcggatatgttcttgataggcttcgtattcagtcatggaaaatccccctttcttcgattatgggaaagggcggcagcacttttttgctgtcgccccttgattacccaccagcaaggacaggcggggctgtcaacggtgggcgcagcccattcacttgccgttgaccggctcggctggatttgctatctttactcgctaagtatcgttgacggcgtaacagactgaaaaacaatcatactgtcaaagatgtcttgcggagtaatcgttactgtatatgctgactttaacattttctgcataccggacaaactaacattaagtgtggtaattgactgtttgctgctcaaaatctgctcccacacttcatcagaagttgcacttgcaaaatcaataaaatactgaccattatctgcattggagaactgattattcaaatcatttgagttactaacttccaaaacctcaaactctccattgcccttttgagagttaaactgcgtttcctgtgcgtctgttcctatcgaatagtatccgttaccaagattgtctgaaagtaattctcccaaacaggtatatcctgcaacagagcttttaccgatgtgaccattatgaccattgataaatagaacggtattatcgccatgctgtaaaaaccactctaccttttcatacatatactggtcacgggtagcgttgtagttatcacttagctgtacctcacaacaggcataaatagtttttgcacattcttttgcaaaatcaaaagccggctgacctaaactgtctacaatatcggtttcaacagtgtccagtttttcaataaattctgaaacgctctcctttgcgctattcaacgccgcttcatctaaggaatttctgttctcgtctgtaagttgtgcaaacacttctgaatattctgcgcttaattccggatgagtttggtcgataacagaaaacagatattccttgttattatcaaaccgctgtacatccataccataaaaatgcaatgcttctttttccgaaacagtttcattgtaggaacgcatccagtctaccaaatcagccatttcctgtgtacgataaatggcaaatcctatttctgcaacgacttcttcagcagttccattaccgccattgatatactggtctactttgagcgctccgccaaaatctccctctatgatgaaagtgtggcaaccattattctctaccagagctttgaatacatctaatttcatttgatgatactgcgccacaccatgacttgcttctcccagccctacaatctgcacatcagaagatacagaaattgtccctatgtcagattgtgtataagatagatctgctgatatagatgattttgtattcccacacccagtaaaaaggataaaacaaattgctgtcgaaagacacaaattaaatattcttttcagcttcataatagatacctcatttttcttcatcaacaaatttaaacaagtcctcaacagtcacatggaatacttttgcaatatccatagctaatttaagggacggattatatctgccattttcaaggtgaacgattgtttctcgtctcgcaccaacaagctctgcaagttcgctttgtttatatcctgcctgctcacgatattctttaatttttgtaacaagagccatatcatacccccttgctgtctataatcacaaacatcaatgtccgaatgatagataaaatcaaaatagacaaaacaataatccacccaatcattcccatattgatagcattaacatgaccaagaatagcacagccccaagcaactacaaccataacagcaacaaaaatcttcaaacaaaatgagtcacaccgtttcaagtttcgctctgccatttcatcaacaccttcctttttgtatttcttaattctcatttgctgaaatgcaaaaaaggcagcaaggaaacagccaagtacaagctgtaaagttggataccagtctttccaatctgttcttgcccacatccagtagtaagatacaagaatgattgcgtagattatttttgttccaacaatttctcttaaagatacttttttattcatatttctttcctctgtgttatatatttcgcactttcgatgttataaatatatcactcctatttgcgtatgtcaatagtgaaagtgaaatatttttaactttcatttttcggaataggggctgccgtcaatcaaattcttgtgtgttactttaccgcacatgaacattgttaccggagataatgtgatgagtattgtggtggagaacgatcggctgtacgaggaagtggattacgctccggtcagaccattggaagaactgacaaaggaagagattatcaatctggtgaaggaagcaggcgtggtaggaatgggcggagcaggattccccacacatgtaaagctttcacccaaggaaccggacaaaatagaatacgtgatcgccaattgtgctgagtgtgaaccttatcttacctcggattacaggcgtatgctggaggagcccgataagcttatcggaggccttcaggtaattctgagcctgttccccaatgcaaaaggaattctggcggtagaggacaataagccggactgcattaagctgttggaagaaatgacttccgaagagccgaggattacggttaagaagctgaaaaccaaatatccgcaggggtctgagcgtcagcttatttttgcggtgacgggacgagccatcaattcttccatgctgcctgcggatgtaggctgtatcgtggacaacgtggataccgtagtggctgtaaaccgcgcggtgcgggaaggaaagccgcttatgaaccgtatcgttacggtgacaggggatgctattgccaatccccagaatttcattgtacggatcggaacgaattatcatgaattgatagaagaagcgggcggtttctgcaaagagccggttaagattgtatcgggcggccctatgatgggattcggtatttttgatctggatgtgcccaccacgaaaacggcatccgcgcttctctgtctgtctaaggatgaggtgggggagccctccgcctgcatcaactgcggcagatgtgtggaagcctgcccctccaggctggttcccaccctgctttccacctattcggagcactacgatatggaggcctttgaaaaatatgacggcatggaatgctgcgagtgcggatgctgcagttatgtctgccccgcaaagagacagcttacccaggccattaaatccatgcgtaagatggtccttgcggaacgaaaaaaagcaagcgccgcaaatcggaaataggaggaaagagcaatgagcgacttgatgaaggtatcatctaatccgcatatcagatccaaggattccacaagcaggatcatgctggcagttatcattgccctgctgcccaccacaatctttggcatctataatttcggaatcagggcactgctgattgttgccataacaatcgcatccacagtgcttacagaatttgtatttgagaaaataaccaaaaggaaaaacaccataggagacctttccgcagtggtgacaggcctgctgctggcgctgaatctgccggtaagcgtgccctggtggatcggggctgtcggcggtatattcgccatactggttgtgaagatgcttttcggaggactgggccagaactttatgaaccccgccctgggagccagatgcttcctgctgatctcctttgcccctatcatgaccaactttacctgtgacgcctataccggcgccacgcctttagctgcggtaaaagcaggcgagagcgtgaatgtgctggatatggtaatagggagaacgtcgggtactatcggcgagacctccatgctgtgcatcgttctgggtgcctgtctgttaatctggctggaaatcattgatctgcgtatccctgccacatacatcatatcctttgtggtattcatggtcctgttcgggggtcatggactggatcggtactatatttcctcccagcttgcagggggcggccttatgctgggagcctttttcatggctacggattatgtgaccaggccggtcaccaaaaaggggcagtacatatatggaattttcttaggtcttctgaccggtatattcagggtatgcagtgccagcgcggaaggtgtatcctatgccattatcctgggaaatcttctggttccccttattgagaggtttactcttcccaaagctttcggtaaaggaggagagagggcatgaaaaatatgttgaaggatgcaggaatcttattcctgattacgttgatttcaggccttcttcttggccttgtttatcaggtgacaaaggatcctatagcgatacaggaggaaaatgccaggcaggcggcccgcagtgaggtatttcaggatgcggatcattttgaggacagcgaagggtttacggaagaagcggcccaggcagtcctgaatgacggcggctttgcccagcagagtattaatgaatatgccgcagccatggataaggacggcaatgttatgggctacgtgattacggtaacgacccatgagggctatggcggggatattaaattcactatcggtgtgcgggaggacggtaccctgaacggtatgtccattctctctatttccgagactccggggctgggaatgaaggcggaagaagtgctgaaacctcagtttgaaggaaaaaaagccgacagctatgtctataccaaggacggagcttctgccgctgatgaaatcgatgctattaccagcgccaccattacaaccaatgcggtcactaacggcgtaaatgccggactgtattattttcagacagaactgaaaggaggcagcggcaatgaataaaccaaccgaacgtctctataacggaattataaaagagaaccccacctttgtgctgacattgggtatgtgtcccacactggcggttaccacatcagccattaacggtctgggtatgggcctttccaccatggtggttctggccctgagcaacctgatgatatcaatgctgcgcaaaatcataccggataaggtaagaatacctgcattcatcgttgttgtagcaagctttgtgacaatcgtacagcttttattaaaggcttatgtgccgtttttggacagcgccctcggtatttacatacctctgatcgtggtaaactgtattattttaggccgtgcggaaagctacgcatccaagaatccgcccatcccgtctctgtttgacggtatcggaatggggctcggtttctcgttcgcgctcacatgcataggcctggtacgtgaaatcctgggagccggtgagtttttcggcattcccattctgggagaaaaagcgccggttatattcggatcccatatcctgcagagttatgtccctgttactatttttgttctggctcccggcgcattcttcgtcctcgcggctcttacagccattcagaacaaggtgaagatcaatggggaaaagaagggcagagacatgtccaaaatccagtccggctgcagctatgactgcatgtcctgcaaggagtccggctgttcacaccgtttttatgatactgctgcgggtggagcgaaggatgcccaggccggaaaaagtgaggagggaaaataaatgttggatcaagtgcaggatttattgcttatattaattggttcttctctggtgagtaatgttgtattaagccagtttctcggcctttgcccgttcctgggggtatccaaaaaggtggagaccgcggcgggaatgggaacggcggttatttttgtcatcacgctttccagcgctgtggccggggcgatatataaatttgcccttgtgcccttgaacattacgtatctgcagaccatcgtttttatcctggtgattgcggcgctggtacagtttgtggaaatggtgctgaaaaaatacatggtttccctttataatgcgcttggcgtctacctgcccctgatcaccaccaactgtgcggtcctgggtgtggcgattaccaatgtacagaagaaatacgggatcttgaccggaacggtcaatggatttgcaacagctctcgggttcaccatagccattattatcctggccggaatccgtgaaaagatggcatataatgacgtgccggaatcctttaagggaatgcccatcatcctgattactgcgggactgatggcgatcgccttctgtggtttttccggactgtcactgaaatagggggtggtgtctgtgagtatatcgggaattctgattgctacggcaatcgttggaggtatcgggctgtttatcggtctttttctgggaggctccgcgatcctgttcaaggtggaagtgaatgaaaaggaagaagccattcttgcgcagctgcccggcaataactgcggcggctgcggttatcccggctgtgcggggctggcggcggcaatcgctgccggagaagcgccggtgaacgcctgcccggtaggcggggctgccgtagggaaaaaggtgggagccatcatgggggtggaagcggaagatggagagcatatggtcgcttttgtccagtgccgcggtacccgtgataaaataaaagtggattatgattatgtgggactccatgactgccgtatgctgtcctttgtgccgaacggcggggcgaaatcctgtaatttcggctgcctcggctatggaagctgtgtggaggtctgtccctttgacgccatacatatctttaacggtgtggcgcaggttgaccgggaagcatgtaaggcctgcggaaaatgtatttccgtctgtcccaagaatctgataaccctcatcccttattccgccaaatatgcggcggcatgcaattccggagataagggtcccatcactatgaaagactgccgggccggctgtatcggctgcggcatctgtacaaagaactgtccggaaggtgcgattaaggtggaaaactttaatgctaccatcgatcagagcaagtgtatcggctgcggtatctgtgccgataaatgccctaagaatgttattgtgatgctttccggcaggcctgtatgtgcagaagggacaggagaacatgaggagaaaggtgaggattaaaaatggaacaggtgacacttgggaaaacagggatctgtgtaaataaaaacgggttcggagcccttcccattcagaggatcagtgatgaagaggcggttcttcttctccggaaggcctgtgataatgggattaccttttttgatacggcccgtgcctatacggacagcgaacataagctggggctggcatttcacgacagatgggatgacacaatttatgtttcctccaaaacagctgcgggcacacccgaaggattttggaaggatttggagacctcccttgcgcagctgcagagagattatcttgatctgtaccagtttcataatccggctttctgtccgaagccgggagatggaagcggtctgtatgaatgcatgctggaggcaaagaagcagggaaagataaggcatatcgggataaccaaccacaggctggcagtggcggaggaagcggtggaaagcggcctgtatgaaacgctgcagttcccctttagttacctttcttcggataaagatctggaactggtggataaatgtgagaaagcaaaaatgggctttatagccatgaaagcgctgtccggcggattgattaataattctgcggcggcttacgcctatctctcccagttccctcatgtgcttcctatttggggtgtacagagggaaaaggaactggatgagttcataagctatgtacagaatcctcctgcgctgacacaggagctgaagaatgtgatcacggatgacaggcaggagctgcagggtgaattctgccgcggctgcggatactgtatgccttgtcctgcagggattgaaattaacaactgtgccagaatgtcactgcttatccgcagatcgccgtcagaagcgcagcttacttcagaaatgcaggaaaaaatgatgcagattgaaaaatgccttcattgcggcaaatgtaaaagtaaatgcccgtataatctggatacgccggcactgctggagcgtaacctgaaggattataaggaaattctggctggaaaggcctattaaaagagaaataaaagctgcctactctgttgccgacagggtgggcattttttatcccttccaagtatttcttttaaatttacggcaataataaccacagttaagtagtgaataaaagaaatctgcccaaaatgtataaaattttcatggggcaggctgtcggttcaatggaggtaactgacatggataaggaaaaagcactggaaattattttagcaaacgcatgctgtacattggagaattgttgtcatttatgtccgtattatgcggatccgccttcgtttgagtgtgaagagatgagcagagacgatataatggaagcagtaaagacattacaaaaataacattcataaataactgatcacgccggcagtctgactccacgaatgcaggaaaatacgaaataaaaaattgaaaaatttataaggatgttacagccgctaagaaagcattaagctttcaggtatctgcttgaccatgaaggaagcttttcctataattgattcacacttccggatacttttcagcataatttgcggaaaagatcattacaatagaagtagggcaaaagaatcatgcatgcagaaggagaaggcggacatggaggaagaatccgatacaggccggatagttaaacaaaaaggagacagtgatgaaaaaataaatattcaggaggggcataacctgcgtggaagacagaagagcaggctatgtttttttataccttttttcaggaagggaatgaattacataaaggggcagcctccgggccggattattgcaatgggatttggctttgtgattcttacaggctcttttctgcttatgctcccatgttcggtcagggaaggcgcacaggtatcctttattgatgccctttttacctctgccagcgcagtatgtgtaacagggcttattgccattgatacggcagagcattttactgtgtttggaagaactgttgtggcgctgctgatccagatcggcggattgggcgtgacatctgtaagcgtcggctttatcctgattgcggggaagagggttggactgaaagggcggagactggtgcgggaggccatgaatgtgaatacctccaaaggaatggtacgccttgtaaaaaacatcctgcttatgacattatgctttgaatgtgtgggagctgttttaagtttccttgttttcgtacgggattatcctcccctggaggcattgggtatcagtctgtttcattcggtggctgcgtttaataattccggcttcgatatcctgggaggactgacgaacctgataccgtaccagaacaatgttcttttaaaccttaccacaggcggactgataatcttcggaggcctgggattcctcgttatcctggatatcttaggaaaccgttctttccggaaactcacgctgcattccaaaatcgttattaccatgagcctgattcttctggcagcaggaacgctgtccctgaaagcaacggagaatgtaacctggctgggagctttttttcagagtgtttccgcaaggacggccggtttttccacctatcccattgggagttttacagatgacggcctttttgtgctgattctgctgatgtttgtgggcgcgtcacccggatccacaggcggaggaatcaaaaccaccacactttttgtgatgatacaggcggccaggggagcggcggccaatcaatatgcaggagcctttaagcggaaaataccggatgatgttataagaaaagcctttatcatcacgtttttatccggtatggttgtctgtgtgggaacctttgtcatgtgccttctggaaccggagttttcttttttacagcttctgtttgaggtgacttccgcattcggcacggtagggctgtcgacgggaattacgccggatttaggaatcccggggaaagcgctgatcataatgattatgtttatcggcaggctggggccgctgaccattgcttctttgtgggcctttaagaccacggcaaatgccaggttcacagaggaaaatgtaacaattggttaggcttgcggcgtatggctgcggaaacaatagaggagagcatagtatgaaactgacaggaaagaataagagaacagaagaaacggcatcctatggggttataggcctgggacgcttcggttcggctctggccctgagcctggctgaagccggaaaagaagtgatcgtggtggacagctgtgaaagcaaggtaaaggagctgaggcaatacacggaaaacgcatatgtagcggatgagctgagtatggaagtcctggaggaaatcgggatccagaactgtgatacggtgattgtcggtattggtgaaaagatcgatacctgcatccttaccactctccatgtggtgaatctgggagtccccagagtgatcgccaaggctatcagcagagatcagggagcggttctggaaaaaataggggcggaggttatctatcccgagcgggatatggccctgcgtcttgcgaaacggctgctgacaggcagtatattggacaatatctccttgaacaatgacgtggaaattgcagaactgcggcttccggatatttacgtgggaagaagtgtgctggaaatggatttgcggagaaaagccggtttgaatattatcgccctgcagcatagcggtaaaacggagatcgaagtggatccggagtatgttttcagagaagacgatattcttgttgtgataggcaagaaagagaatatccgaaaatttgaaaaggataaagacgaataaacaggaatgagacagtaaaagcgaatggaggaatgtatgcaggaaaagaaagacagcagtatcagcgttatgttaaaggggatatgtgtgggaggaaccatgcttgtacctggctgcagcggcgggagcatggcaatgattctgggggtatacgacagactggtctcatcagtcagttcttttatgaagcacaagaaggaaagccttttctttctgaccttgttctgcctgggaggaggcctgggcatgatactttttgccagacccatgttaagcctgatggaacggtttgaaatgcccatgctttacttctttattggggcgatcgcaggaagcgttcccatgatactgaaaaaagcaagctgggaaaagggcggtttgggaaaactgctgttctttctggcaggtgcggctgcagtaggcctgtttgccctgcttccgtcggatacatttcaggtggatatgagcgccgggctgacttcctatctgctgcttatcctggcaggtgtgattgccgccatagctctggtgctgcccggaataagcgtttcctatatgctgctactcatgggaatgtatgatacggttatgagggccattacggaaatgtaccttccttatttgattcccataggtcttgggcttgccctgggtgtggtcgccaccaccaaactgctggaaaaagcgatggaaaagttcccgggaccgtcgtatctgtgtattctgggttttatggcggcttccatggcccaggtatttccgggcctcccgtcgggaggagattggctggtatgcccgctgatgctggcagccggatttttacttatccgttttctggcggagggggaaatcaggaggtcgcttcaaacagtatcccgctgaggccgctgctgggatggagctgataatcctccgtaataaagactgcttctatgtcagggagggattctatcagcttcataccttctgtcagacccagtacaaagcaggtggtgctcagcgcatccccctccatggaagaaccggagaggatggtaacgccgagaagcccgttctccacaggatatccgctcgccggatccaggatatgatggtaaagcctgccgtcctgccggaaataacgctcatacaccccggaagagactaaggagctgtctgaaagggaaagagtggcaattgcctttccatgctcatcaaaaggcttctgcatgcctatggtgaacggactgccgtccggcttgctgccaaggacgaccacatttccgcccagattgatcagggcgctctgcacaccgttagccttcaggagctccttcagcttgtcggcgatatatccctttgcaatgaagcctaaatcaatttgtgacataggatcatccagaatgaccgtagtattttcaatatgaatattcttataattaatatgaggaagaacagactggatatcggcatcggcaggtatccttttttgtgcgctttccgttcccgcctgtccgctgaaattccacagatcatcgagcggagccaccgtgggatcgattttgccgccgcttaaccgggcataattgcaggcctgttccagaagacgggcagtttcttctgatacggcaaccggttcccccgaactgtggttgatgcggtagatatcgcttccttccactgtacggcccagcattttttcgtaagtgtcacacaacgaaaaacagtcctccagatatacggcgtcctttggatgataaacagtaatggaaataacagtattaaagtaaaagccggtttcggtctgcggttctgtcctccgggaacagccggttaaaaatacgtctgaaagcagaaaaagcagaatcagacagaaaagaacgggtttatgtcggtatatgcgatgcttcatgaagaacctctttttcatgtggaataaataaaggatgtcccggaaatggcgtatttacggggattttttatatgcagcttattataacatgttttcgttagagggacaaatccttcgttaacctgaaaacttgtctgaaaacagatatattttgcgcacccactgtataaaatatgaatatactattgaataagtattacaaaatgattacgttttgtaacagaaacaatagaaaggtatggtgtattcatttatgcagtataaaaaatacggattgattttactcttttccaatttgcttgttgtcatggcatgggtctgcgtcaatggagtgcagattaataaaattgcttcccaggaagccttcagagcttcttttatggaggatattgccgaataccaggagacaagcttccgtactgttgtaccggctgccgcttccgaccagcgtgtccttgaatgcggagtactggaaaaaaagccggtatatgaattaaatgacgcagattataatacactgttgaaaatagtagaggcagaggccggcggcgaggacgagaatggaaagctgctggtagccaatgtcgtattaaaccgggtgaacagcagtatctttcccgacacagtaacggaggttgtctaccagcgggaatttggcgtctgccagttttcaccggtcatcgatgggagaataaacagggttaaggtaagcgaagagacaaaaaaagctgtggagagagccatatatggagaggatatatcccagggagcattatactttgtggcgcgcaaggcagtggccgcggataagatgcagtggttcgacagacatttgacccgtcttttcgcatatggaggccatgaattttttggttaataaagaaaatactttcttcttttaaaaatattatcatataaaatgccgtttaaggtcaaaaatgtgcagttgaaggacaaatggctttcttttccaaaaaaactgatattatgattacggaaagcagataggaggaaagaggagttgttaaaaatagctttggttgatgacaatacagactttcttttgctcctgcgcaaaaaggtacatgcgttctttgatggcagaaatgttttgtgcgaggtcagacttttccctaacccggaggttttttattttgatctggaagaaggatttcattacgatatctgttttctggacatagaaatgcctcaaatgaacggcttggatcttgcaaaaaagatccgggctaccgcgcaggcaacctatctggttttcacaacctcatatcttcaatatgccgtagaaggatatgaggtacaagctttttcctatatcccaaagaatctcctggaagagaagcttgacgctgctcttctggggatttttggtgaaatgcaggagaaaacagaaaaatattatttcgtggaaacgaattcccgttttgagagaatcgaatataaagaaattatttacgtatataagaataataagaatgccgtctttgtattaaaggacagagaggtgccggtacgcaaaacccttcaggaggtttatgtgcagttggaatccgaagagtttatctgtattgagagaggctatatcgtaaatgtccagcatatcataaagattgaaagcaaggaactgacgctcagaaatgggaagaagcttcaaatcggcagaacacatatcagggaagtaaaggaagctattcactgttattggagggatagaatgtgatcgggctaagaatagcacaggggctgctttgtgctgttgaggtatgcggactgtattttctgattcagcttttctttgaaagaagatgggatagcagcttcagtaagattttgtggatgatatccggggctgttttatgcggacttataatttatcaaaaggatcaggtgtcgatgtattcgagatattttatgctcgtatgcattgtgctttctgcgttcctaacaaaattctgtgttgacatatctttggcaaaagctgttcttatttcagctttgtattttgagtctatctgtttttctgatatttttctgagttttatcggacaggccttatacagccgtaacgattttttcgaatatatacaatatgagatgagcattaagcgaattcttcttatggcggtaagcagaatattccttggtgtgagtgtttatctgcttatgaaatacaggctgcttgtccaaagaattttttccaaatatatactgattttcgccggatatgccgtattggaatacttcggcctgcttttttgcgatcaggtttttatacctgcctttggttttcatgaaaagatatatatttatttcgccctgtatcccctgattattacgttaactcttatagttataattctttacataatatttattgagagaaagaacgaaatccggctggtaaacagccagaataaaatgctggaaaaaaattatcatgaaatgattatgctgtatcacaatcgcgacaggatctttcggaatatgaaatctgatttgacatcgctttccacgctgattgctgagcaggacttaaataaaattgaagagtatattgacaaattaaatgaacctattatggaaatggaacacaaggactttacaggcaatgctatagtagacaccatattaaatgataaggctgaaaaggcaaaggcttctgatatcagtttaaatattaagaccaaagaaattaaaaagaataaaatacaggatatagactggtgtgcaatactggcaaacatattggatggcgcaatcgaagcctgctgcagggtaaaagaaaaaaagagattgattgatctttgtatcatgcagaatgactgcaccacctttatagagctttcctatacttatgagaataagaacagtatccgtaatgataaattaccggataataaaggtatggaaagtgatttggatgataataaaatgaaaagtgtccgcagggccgtggaaaaatataatggaatctttgattatgtctggaaggatgggatctttacgattaatatgtcactgttttattagttatagtaactgggtaaatttaaaaaatgtaaattaataattaaggcggttgtgttcttctgctgtccctaaaatggttaaaggcaaaatgttttgttacacatcttgcctttttgtgttatttaaaaatgaaaagaaagatttttattttttatattttcttattgctttatttatattataataaaaaagtgccgtttgaggtcaaaaacgtgcagttgaaggacaaatggataaaatttcctttttagctgatatgattggaacgaaaagcagatgggagggagtaagtattgcttaaaattgctttggtcgacgacaataccgacttccttctgctcctgcgtaaaaaagtgcatacgttctttgatggcagaaatgttttgtgcgaggtcagacttttccctaacccggaggttttttactttgatctggaagaaggatttcattacgatatctgttttctggacatagaaatgccacaaatgaacggactggatcttgcaaaaaagatccgggcatctgcgcaggcaacctatctggttttcattacttcatatctacaatatgccgtggaaggatatgaagtaaaagctttttcctatatcccaaagaatctcctggaagagaagcttgaggcgactcttctggggatttttggtgaaatgcaggaaaagaacgaaaaatattattttgttgaaactaattctcgctttgagaggatagaatataaagagattatttacgtttataaaaataataagaacgctgtctttgtacttaaggacagggaagtcccggtacgaaagactttgcaggaggttttcctgcagctggattcggaagagtttatttgtattgaaagaggttacatcgtaaatatcgaacatattattaagcttgagaacaaagaaattacgctcagaaacggaaagaagttccaggttggcaggacacatatcagggaagtgaaggaaactatccatggttattggagggatagaatgtgaattggctaagaatagcgcaaggggtgctttgtgctgttgaggtatgtgggctgtattatatatttaatcttttctatgagcaaaaacgcgataaattatgggaacgtataagttttattattacacttatactattttgtggtttgacaatttttcaaagagaagttggcggaatgtattcccgttactttatgtttttgtgtattttcttagcagtatgcattggtaaatttttttataatattacatttacaaggtgtctgttggtttcgacattatattttgaatctatttatttttctgatatttttttgggttatattggacaggctttactagattcaatagattttgtagactatatccaatttcaaataaatttagaacgtattattattttgggtattactagatgtttcctattgatagtgctattcattttaagaaaatataaaatacatgttaataatctatgttttaactatagaatgctcttaatagggtttgcagttttagaatatttaggattattcagttgtgaaaaagtatttattcccgcatacagggaagaaggaaagatatatgtttactttgctctatttcctataattttgatcttaacatttattattgtaatagtctatataatgtatatagaaaagaaaaatgaaatgcagttaatgaatagtcaaaatgaaatgttagaaaaaattatcatgaaatgttattattatatcagaaaagagatagaatttttcatgatatgaaaaatcatttatcagtactatcattgttaatagcagatagaaatttagatagggcagaagaatatattaagaaagtaaatgcacctattttagaattggaacataaaaaatatacgggtaaccgtatagtggatattatcctaaatgataagatagaaaaagcccataacaataatattaaatttattatcaatgcacatgatataaaggaaggtataattcaggatatagattggtgtgcgattctggccaatatattggataatgcaattgaagcgtgtataaaagtacagaatgatgaaaaatggatagagatgtccattagtcaaaatgattgttctactattattaatgttactaatatttataatggtgaaattaaaatttcaaaagataaattggaaagtactaaaaagaataaaatacttcatgggattgggatggaaagtgttaaaactgcagtaaataagtataatggcatatttgagtacaattgggaagcggatatattttatatttatatatcactatttaattaaaggaggatgaaaccaatgggtaacgaaagagaacagtttatggaaaatgcaggaaatgtattgtttgaagtggaagaatcaggaaaagaaatgatgaattctaatcaaatacctgcaaatacagaatccactccttttctttcaattttctgctgttaaggttaaaaggcaagatgcttaattagacatcttgccttttttctgttttatagataactaaaatgaatatagatagttaggaaatacatgatatgattgatgaaggtaaaaaattattattaggatataatgatattgatattttaagtaatagagaattttcaattgttcaaaaatatacttttggtgctttctatctccacttccttgcagaaacaaagaaaaaattcattgaagaactgggttcaatctataatcctgatatgttctgcaatggtattccggaactcattctttcacgtctccatgcggtatgtgtaagagcgctaattgtagagatgagcatgtataaggcggctggacggcttaaaggcaataatagcggtgaagagtatgaatactttcaggaacagtttcttgtaaaacaggagatgagagaagaactttttcaggtatatccattgttgaaacaaaatatcacaaggactatcagtcaatctgcgaaatttttaagcgatatgtggaagcgtctgaatgcagacagaacggaaatagagaaaaacataattggaggcggacctttgggaaacatagtgtctgtttccggtgtgggttctgattttcattgtgaaggtcagtgtgtgttaaaaatagaaacagataaagggcagaaatttttatataaaccccggcctgttcagaccgaaaaggcttttcttgtcttgctgaatcatctatataaaggaataggtatgaatgaatattcctatggatgtgtactgcgtgagaattatggctgggtcgaatatgtagaagcggaaagctgcatggaaccggagcagattaatcgttatttccaacgattgggtgtaagtatatgcctgagttatttcttgggtacaggagatcttcattatgaaaatcttattgcgcatggggaatatccggtaccggtagatgtagaggtgttttgtactcaggcgggagggaaagatggtacaaaggaagggtattcagtcctgttcagtggaatcctgcctgatccgtcaagaagcacaaaagtaaatatactgaatggcggggaagggcaaaaagcatcgattaaagtagcacgagttattaacgataagacttcggatatgaaaatagcttatgattatccggaaatgcctgtcgctgataaccaggtaatgctgaatggcagcaggatatctgcggctgcatatgagacggatatcaatgatggctttcgaaaagtatacaattttattatggaaaataagagtaattttatagctttatttgtaaaggaaagcctggaatgcaggatcagggtacttctggaaaatacacagagatatactatgcttttgtcaggcagtggtcatcctatggtattacaaagtgctgaaaaaagaagggaactgctggaacatatatatgaaggcaaaaatggactctccctaaaggaaaagcaggctgtggaatatggaataagagatctggaagaaggtgatattccttattattttacagaaatgaacagtcattctctttttacatcccgcaaagaagaaattgatgaatacttttccatatcacttacagattgtttccgttttagaatggaaaaagcgggaagattggattgcagcagacaagaacagattatccgtatggtgatagaattatccggatacggaaaagaagagtttgtaaatagtcattttcctgtaaagaaggtagataaaaaacaagatcccgaaaagcaaaaacaattttttttacataaggcaatggagattgcggcgcagatagaaaaggaagcattatgggataaggacaggcagactgtcagttggatagaaccattattggcaggggtgaaagaggaaagaattcatatagtggatggagacatgtatttttataatggaatgtccggcattgctgtttttctttatagtataaatcgtgtatccggaaaactgaaggcactctgcgaagctgtaaaaaatacaatgttccaatatactgatagctgtttgatggacagaagaaggctattgtcagaaaatacgggaattttttgcggagaagcttcgttgtgctattcctatcagcttctataccgaatgacagaggacgatatttttctggaatatgccaggaagcatgtagtactgttgacagaattgttggataaggatactgtttttgatttggtttatggtaacgcaggggctattctggtattatgcgggatgtattctttcactcaggacattcagtatttgaaagaagcggaaaaggcaggggatattgtggcggcgcatgctgtcagtcagggtacaggatttggatggataaataaagcttctcaggcggtattggcaggtatgtcccatggaaacagcggaatgattccgggtttgataaagctgtcctatttattaaacactgacaaatatgatggcttgattaagggctgtttggaatatgaggacagcttgtatagtaaagagtatcataactgggctgatttgcggcaggaaggtgatgaaagatatcaggcctgcgcctggtgccatggttttggaggcattacggtgtcaagactcgcctgtcttccatatgcaggagtggaactggaacagcgtcttaggcaggatttatcgcgggcggagaaatgtttcctttctttgcagatgagaaaaggtatgtgtctttgccatgggaatctgggaatgctgctccttttggataaatttatggaatataacagcagcagtggattgaaatatattaaggatcttcttgttacggcaactttggatgaattggagcacagtcatatcatgcctcaggaaaaatatgcaaagggaatgatgaatggaatggccggtatcggatatgcctgtctgaagctggcgggagttgattctctgccggatattatgttgtgtgatatatgagtgaaggataccgaaaagcatgctgctggaaaaagttaatagttgggaaattagtgaaggatagcagcagggaataagaagtttgccagcactgtccttgcaggaaaaacaaaagtgtgtcagaaacggattgcatcaagaaagaatgtatgctatactgatgaactgacgggtgaaaacaacggatgccgtgctttacgagtcctttacatgtcccacggaatccggcaaagcccggttttgaagtgtccggtttaccggatggaaatcataggagaaattaagcctgccaggcaggcggtgaggagattgtgaaatggagatcttatacagaagtaccagaagtaatgctgtagcaagcgcttcccaggcgattctgaaaggactttccgaggatggaggcctttttgtaccggaaaaaatccctgcgttggataaaacgctgcaggaattaagtaccatgacctaccaggaagtggcctatgaggttatgaagctgtttctgaccgattttacggaggaagagctgaagaactgtattgccaatgcgtatgacagcaagtttgatacggaagtgatcgcacctctggcagaagcaggaggggcttattatctggaacttttccatggaaagaccattgcctttaaagatatggcgctgtccatcctgcctcatcttatgattacatcggcaaagaaaaaccacgcggataaggatatcgttattttgacggcaacctccggagataccggaaaggcggccctggccggtttcgcagatgttccgggaacgaagattattgttttttacccgaagaacggagtgagtccgatccaggaaaaacagatggtcacccagaaaggggataatacccttgttgtaggcattcatggcaattttgatgatgcccagacaggtgtaaaaaaacttttttccgataaggatctggaaaaggagatggcagataagggatatcagttctcttccgccaattccattaacatcggacgtctggtacctcagattgtttattatgtatacgcatatgcacagctgctggcagagggcaagatcgcagcggacgagaagattaatgtagcggtgcccaccggtaatttcggtaatatccttgcggccttctatgcgaagaatatggggcttcccattaataaactgatatgcgcatccaatgaaaataaggtgctttatgatttcttttccaccggagaatacgatcgtaaccgtgattttgttctcaccagctccccttccatggacatcctgatttccagtaatctggagcgtcttatctataggatagcaggggatgatccggtgaaaacagaagctctcatgaaggctctcagcggagaaggaaaatatgagatcacttcggagatgaaggaaaagctggacgatttttatggcaattttgcgaaggaagaggaagccttcggtaagataaaagccttgtacgaagatacgggatatgtgattgatactcatacggcggttgcatccgctgtttatgacaaatataaggcttctacgggagacaaagatacgctgacggtgattgcatccacagccagtccgtttaagtttgcgagaagtgttatgcaggcggttgatcccaaatacggcgatgcggcatggggggattttgaattggttgatgagttatcaaagctggctaacgtagaagttcctgaagcggttgaagaaatcaggactgctccggtaaggcatacggcgatttgtgagaaagacgggatgaaggatgtggtaagggactttctgaaattataagaaatggctgtcggcggcatatagaatactgcaggcattgtccgggacaaaaaacagagccggcgcatcaaagcgccggcttactttatgtatcaggatactgtatgaaatgaacggagaaaaaatctccggatgcagcagctgattaagtacgatctgcaagactaacgtattccttttcctggcatacggtcttatatgcagggcggataatctttccgttgttagccagttcttccatacggtgggcgctccagccgaccattcttgcgatggcgaaaataggagtgtacagctcggtgggaagccccagcatattgtaaacaaagcctgaatagaagtctacgtttacacttacgcccttgtacatctgtctttctccggatataacatagggagcaagcttttcaacaagattataaagttcaaattccttatgaagtcccttttcttcagaaagcttctccacgaagcttttaaggataatcgctcttggatcagatttggaataaaccgcatggcctacaccatagatgaggccggcatggtcaaaggcatccttgctcagcaggcgttccagataacgggatacctcttcttcatcggtccagtcctttacttcttttttcatgtcttcaaacatctgcataactttaatgttagcgccgccgtgacggggacccttcagggaaccaattgcagccgccattacggagtatgtatctgtcagtgaggaggtaactacatgagtggtaaaggaggagttattacctccgccatgttccatatgaagaatcatacagatatcaagaattctggcttccagcggagtataggaactgtcgggacgaagaatgtgcagaatgttttccgccatggatccttccgtcataggctgatggataaagaggctgttgccgtcatgataatggctgtaagcctgataaccataaatagataacatagggcataagctgatgagctgcagacactgtctcaatacgttggggagagaaacatcatccgctctgtcgtcgtaagagtaaagagtgagaatgctccttgccagggtattcatcatgtccttgctgggcgccttcatgataatgtctctcacgaagcttgtgggaaggcttctgtagtaaataagcagcttctcaaattctgccagctcctgtttatccggcagcttgttgaagagcagcaggtatgtaacttcctcaaatccgaaccgatgatcttggtggaatccttctacaagatcgttaacttcataacctctgtaaaaaaggtgaccatcacaggggaccgatttaccatccaccatttttgtcgcacggacatcagaaatattggtgagtccggccagtacgccttttccgttcaggtcgcgaagccctcttttgacatcgtattttgtgaaaagctcggaatcaatgacacctgcttccctgcttaattcagccaatcgtacgatttcaggagtaacatcagaatagctgttgtgttcttccattcaatcaaccacctttcctcataaatttattatccctgctttcctttccatccggtcttttctggtttgacacgttaaaaaaggaaagtagataatttacataataacatgaataacaattcgaaacaagaaaaaatgtatttatttagaaacatttaacattttgttcactattcgggatagcttttttgtgcgtattgtattacaataataggcggcttacagcatatttttttgatgctgaaggccggaatgaaaaggtcacatgttcagaataaaaaaagtaaaggaaggtgtacgaaaatggataaaaaagaaatattaagacatattgaccacacccttttaaaaccttatgctgtatgggaggacatcagaattctctgtgaggaagctgtggagtataaaacagcgtctgtatgcatcccgccctgttatgtggaaagggtacatgataaattcgatacattgaatatctgtacggttgtgggattcccgctgggttacagcgtaaccgccgcaaagctggctgaagtggaaaaagcccttaaggacggtgcgaatgaaattgacatggtggtgaatatcagtgatgtcaagaatcatcagtatggtaaggtagaggcggaaatacgcgcgctgaaggaagcctgcggcggccatgtgctgaaggtgattatcgagacctgctatcttacgggagaagagaaaatagccatgtgccaggcagtgacaaaagcgggagcggattacatcaagacatccacaggcttcggcaccggaggagctacgctggaagatgtaaagcttttccgtgaacatatcgaaccgtcggtgaaaatcaaggcagcaggaggcgtgaagagcagagaggatttggaaatgttcctggaggcaggctgtgacaggatcggcacttcctcggcagtgggacttctgaaaggggaggaagccggagattattaaaagggcttcctcaggaatctaacagtaaaagcaaaggagaaatattatgaaccagacaatccggaatcgtatagccaagctccgggaagctatggaacgggcgggggtcgattattatatggtgcccaccgcggatttccacaattctgaatatgtggatgtttattttaaagtaagggaatatctttccggttttaccggatccaacgggacgcttgtggtaagccgtgatgaagcgggcctttggacggacggacgctattttatccaggcggaaaatgaactggagggaacgggaatcactcttttcaggatgctggatgaaggggttcccaccattaaggaatatctgaaggatcatatgaaggaagggcagacattaggctttgacggcagggtggttgatacggcctttggctgcagccttgaaaaaatccttgaggaaaagaaaattacgtttgcctatggaaaagatctggcagatgaggtttggacggacagaccgtcgcttcccagccatccggtcatggtgctggatgaggcgatatgcggaaaaagcgccggagaaaagctggaagatgtccggaaggccatggagaaggaagaggccgatgctttcctcctcagcaagctggatgatttgatgtggctgtttaatatccggggaggcgatgtggaatgcaatcccgttgctctttcttacgcttatattaccatgaaggaatgctttttctttatccaggatacggaaataacggcggaactcagggcacatgctgcgaaatatggcataacgctcaaagactatgataacatagttcccttccttcagagcaggacggaaaaagaaaaggtcctctatgacggacgcaataccagctacgctctttattgcacccttcgtgaaaaaggggagtgtaaggacggtaagaatcccacggagctgatgaaggccattaagaatgaggtggaactcgcacatatggaggaggtctatctgaaggacagtgccgcggtatgtaagttcatatactggcttaagaaaaacgtgggaaaaatgaaaataacagaggtgacggcggcacagtacctggatcatctgcggagtgaaattgacggttatctggatctttccttccccacgataagcggttataaggaaaatgcggctatgatgcattatgaggctgtggaaggcagctgcaaggagctttctccggaaggaatgctgctggtggattccggcggacaatatatgggcggaaccacagatgtgacaagaaccatcgtgcttggccctgtttccgctgagataaaagaacatttcactgcggtagcggcaggaatgctgcagctgacgaacgccagattcctttatggctgtacggggagaaacctggatattctggccagacagcccatgtgggacaggaatatcgattataaatgcgggacgggacacggcgtaggctatatcctgaatgtccatgaaggcccccagggaatccgctggcgttttacggaaggtcagacagaagccgttatcgaggcgggaatggatgtgacgaatgaacccggagtatatatagaaggaagtcacggaatccggaccgaaaatgtaatggtggcgcaaaatggagtaaagaatggtgacgggcagttcatgtattttgataccctgacctatgtgcccattgatttggacggaatcgagccatcccttttggagcccggacagctgaagcttttgaatgattatcacaaggctgtttatgaaaaaatttcgcctttgcttaatgaagaagaaagagaatggctcaaaaaagaaacacgggaaatttcttaaaatttatcgtcagtttttccggcctgttgtaccttacaactgggccggacattcctttcctttttttactgttgtaatttcattataatcaggatataatataactaacctgaaatgttcgataactcttgttgttttgaacctacagttactttaaacgggactcctacattgccgcgtggatgtcaggccctcattgcgcaggggaaggcagaagcgccggttgcggtaacccacctagcagtcagctaggagtcaaaagacaagagccggcattttggggatacaaaagataagagcagccattacaggctgctttttttcaagtgtgccggcttgtccgctgtaagcttaaatacatagggttgtttgcggggcggcgtgcgtgaaaattatctggaaatggatgggattcaaagatgtaaggggagtatatggaaaaaggcggaagacagggaagcagcaggagaaccggccgggaatcaaggctgtcaaatcagaacacccgtaattcggacgcgccgggacataacagattcctggacgcgaagaaggaagcggacaaaagagaggcggagcatgcggcaagaagccgtgcggcgcgtatgaatgccggcagaaaagcgttccgttcaacggctgtgagaagttcccatggttatggaaaacgttacggcagttacagggcggccgctccgaaaaacacttccggaggccgctggatgaagctggccgttattattttgggagtggcgcttctgattctgctgttggtacgttcccttgtggaaatgacaatcccgcgtacggaaggagagtacctttcgctgcaggaagcggggaatctgacctggcttctggcggataccgggggagtatcggacagcaaaacgatagcggctgttttttccggtgattcggcagcccaaagcgacggtatgctgacctttgcacaatggaaagacattgccggtcttttcccggactgcacatatgagcttccgggcggttaccggaataaggataaagtccttcaggatgactggtatccttatttcgacgcggtgagggccgtttatgataaagacggaaggattcaggatatggatctgacgccgattggtttgggcggttcggtttccgacgcagatggaaaccggctggaagataatgctttgatttcgttggaaagtgtatacacttatatgagtgaccggattccggaatgtctctggcagcccattgttgcggtggagcgggaaggcgtgctgtatgcgctgagggagaaaaccgggacacagacggaaatttcgaatatatggatcatggaggtggaaacggattccctccgctgtttttggaatgattatgaaatcaccatttcggcgcctgaagagaaagcggccgctctgggagcagccagggagcaggtggctgatttgagctttgcggacggtttgctcgcaggcgtgaaggtgcatatggataaggtgtccggcaagcttcttaaaattcgggataacggggcggaaattgaaggctgcggcttttatcctttttcggatcaattaaaaatataccgtctttacggaaaactgcagaaatatttcacaaccgatttgtgtatcggttatgattttacggattttgtcattgaagacggagaaatacaggcctgtcttgtggtaaaggaagaggcgatggagaatatccgtgtgctggtaaagacctcggatttcgggagcgccttccacgattcgctggaactgaaggcggactgtgatctttcggtgatcaccgggccctacggtgagcagcagacaacagtggttccggcgggagagacactgaccatcgccaaagacagtgagctttttacagcggagagaatacggatagagcctgcggtattaaccgggcatatcagtcttatgaatgtgaaaagaagccagggagtgccttcttacaggggaagcttggagctggagaagcagcaggacgggatcgtggtgatcaatgaggtgctgttggaggaatatctgtatgcggtggtgccgagtgaaatgccatcctcctatccgttagaggctctgaaggcccaggcggtatgtgccaggacctatgcttatgccaaaatgcttcacgcgggtctgcccgcttacggagcccatgtggacgacagcgcgggattccaggtttataataatattacggaaaatgtggaaactactaaagcggtgaaggaaaccaaaggagaactgctttattacggggatcagctggcggaagccttttattattccacctcctgcggctatgggaccaatacggggatctggctgaattccgtgccggataatttcccttatctgcagggaaaggcagtgaacgtggcgggtgtgacagatgcccagggagatacgattgacgataccgtaaaggaagaggatatccagactgcggattctatgacagaagaagcgaattttgaagcctttatccggggaaccagagattccgattttgagagggaagaagcatggtaccgctggacctaccaggtggatcagctggataatacccttatgtatgccaatgttgtcaaacgctatgatgccagcccgggttctgtttatgtacggcaggcggacggcagctttgtgaatcaggcgcctgtggatccgggaaggattaccgacatatatatcgcggccaggaatgccggcggtgtggcggaggagcttgtaattgaaggggaaaacggcgccctcatgatcaagtcggagcataatatccgttatgtgctcagcaacggaaccagtaaggtgatccggcaggacggaagcgagtataacacggctgctttgctgcccagcgcatttatcgtactggaaactggaaaagaggacggctatgtggtaggatatagtttgattggcggcggattcggccatggggtgggcctgagccagaatggcgcacggagcatggctgcggacggctgcgacagtgattctattttgggattcttttatgaaggaagcggagttaagacggtctattgaccgttgaactgccgcgtggtgaagaacgttttatgacagcagtgacaaataagcaaaggaaaggaaagcaggttaatgagaatttacagaattctgagagggtttggaaggcagatgtcccgtgcaaacgtgaatgcatatgcggcaagcacggcttttttcctctttttgtccctcattcccatgctcatgctgatatgttccattttaccgtatacgccgataaagaagtcggatattataacggcggtaacgcttttgcctcagacactttctccgctgctgacttcactgatacaaagcatttatgacagtaccttcggtgtgatgagtatcgcggccattgttacggtctggtccgcgggaaaaggtgtgctggcgctgatgagaggattaaacgccatgaacggtgtggtagaggataggaattacgtgctgcagagaattatcgcctctttctatctgatcatctttctgataacgattatatttttgctgatagtaatggtattcgggaatttattcgcggatacgatagtgcggcatgtcccccagatggaagatctgtttgccctgctgctgcatttcagggggctgttttcctggtgtatgatgactctgatttttgcggtgatgtatacctatatccccaactgcaagctgaagttttcacaccagatacccggcgctgtattttccgcaacgacatggaatattttttcctggggattttccatgtatatccagcagttcaacgggttcgatatgtatgggagcctgacgactatcgttattgtaatgctctggctttatttctgtttttatctgttcctgataggggcccatattaacagattcctgacacccttccgcagaatcctggagaaggagagaagataaggctgaatataaagaaaaggcagccagccgctgcgtgttctcgggattcataagtgtgagaccggacaccagcgatacacggctgtttccatgagaaacggccggctgcactcctcccggaactggctgcacagcctaattataacgggattgggctgcttttgcaagattgtgtgcagggtctattgacagaaatcggggattgtgttacattaacgatagtttatagtgaaatgaatcattttctaaaaactgtgatgggaagaagtaaggaaaagaggaacctacagaaagcggccggcagatgagaggcgcaggagaggctttcccgaatacatcccggagtttcgcaccaaaatcatgtgagagtaggctgcgacggagagcaaccgttattttgcgaagagtatcactgggacgggaacggactgcaggccgtaacagaacagtcgtacttgatgagacagacggcgcgagccggctgtgaacaaaggtggtaacacgggtatctgacactcgtccttttttccggattttgacggaaagaaggatttttttgttttaaggtttccgtttacgcctgtactgtgagaaagagaaaaggagaaaagaaaaatgcaggtatttgaagaattaagagcccgcggattattggcgcagctcacggacgaagaagaaatcagggagctggtcaatgcgggtaaggcaaccttttatattggttttgatcctactgcagacagccttcatgtaggacattttatggcattgtgcctgatgaagagactgcagatggcaggcaataagcccattgcccttttgggcggcggaacgggcatgatcggggatccttccggaagaagcgatatgcgtaccatgatgacaagggaaaccatcgaccacaattgtgaatgcttccggcggcagatgagcaagtttattgatttttccgaagggaaagcgattctggcaaacaatgccgactggctgcttgacctgaattatgtggaacttctgcgtgatgtgggagcgtgcttctccgtaaaccgcatgctgacagcagaatgctacaagcagcgtatggaaaaggggctgagcttcctggaattcaactacatgatcatgcagagctacgatttcctcatgttataccagaaatacggctgcaatatgcagttcggaggggatgaccagtggagcaacatgctgggaggaacggagctgatccgcagaaagctgggcaaggatgcttatgccatgacaatcaccctgcttctgaattccgaaggaaagaagatgggcaagacgcagagcggcgccgtatggctggatcctaacaagacctcgccctttgaattttaccagtactggagaaatgtttccgatgcggatgtgctcaaatgtctccgtatgctcaccttcctgccgattgagcagatcgacgagatggacaaatgggagggcagccagctgaaccaggccaaggaaatccttgcatttgaactgaccaagttggttcatgacgaggaagaagcttccaaagcgcaggaaagcgcaagggctcttttcggaggcggaaatgcggcggaaatgcctaccgcagagctgacggcggcggatcttaccgatggaaatatcgatattctggatctgctggttaaatccgggctggtggcatcccgttccgaaggccgccgtgctgtggaacagggcggtgtgaccatggaaggggaaaaggttacggacttccgcgccgtatttgccggtgaagatttccatggtgaaggcaaggtgcttaagcgcggcaagaagaatttcaagcgcattattgtgaaataaagaaagaatgactgatggaggaagccttttctcccgcaggccgtaattggtatttacggcagcgggggagagggctttttgtgtttctgcggattagccggacagcatagcggcctgaatggaagatatcattcaattgcatgaggttatattcaaaaaacaaagatggaggggaaaagaggtttccggtataatgaattatagggaaataccaagcggggagtgggaaaaatggaaaaaagagataagaacatcagttatctgcgatttgtaattacttataatattgtgctgctgattccgctgttgatcgtcagcttcagtgtgttttatatggtgcacaggcagcattacaggaaaatcatggacgagactgcggtgtcggcggaacggcaggcggattatttcaaacagcagatcgctgttatctgcgcctacaatgcggactgccgctacagtaagatctacagccgtcagtattcctccaatcccccggtatcctatctggaaattgcggaggatttaaaaaagaaggaaagcaccttccccttcgtggacagtatgtattattatttcccagacgaggaacgaaaagtagtttcttcgggcggaacctttacggaggatttgttcttttcccgtatctgccggatggacagaaatttattgggtaagatggaggatataggcctgtatgctgtgagggcagagctttatgaaggaagcagcatgggaatggtgatcatctgcccgttaaaaacctggatggagaaaggaaagtcggatacgcagtatcttttttatgtgatccgggacagcaagctgatggaacaattcggcggttccgggatgccctatgaagatattacgatggttgcttttcaggatcaggttcttttttcttcaagaaagggggacaatcgtgcccttctgaatggaagcagggactgggagcagcttttggaggaaaaggattactacagaaatataacggatatggaatccggattttctgcattgacttttgtttccagggaggaggtttccaggagcgctgtgagctatttcaggggatatggtatctggatattatgttccgtagcggtgggaatcctgctggcactttattattccaggaaaaagtaccagtctttcaggagcctgctggataataatgaaatgctggaggaagaaagaaaccttctgcgggcggaaaactgtctctacgagctgcttaccaaggaagtgaagccgggggatgagctttgggagcgctgcctgaaaagcagcatccatattaacagaaggcatctgttttttgccgttttccccaagatagaggaaaacagggagctttatgaggtttttcacacccagatgaatgattacagcgcttccaccgcatatcggattgtgctttttgaggaaatgtatgtatatcttgtctgttccgatgagtctatgggagatatttcacgcaggctggaaaagatttcaggaagcggagtgaagctgggagtgggcaggatcacttcggacgtgggaaaaatccgcttttcttatgaggaagcccgaagggagctgcgccgggaacagcatgaggagcagcgtttcccgggacaggagctgaaggctcttaaggatgcggcaggtctggctgactccgtacgtacggtgatcctcctcacagaactgaaagaaattgtttctgaggttaaggaaagcatggccctgtgcatcacatgggaggtaatgcacatattaaaccgggagccggaagagtttcttgacggaagaggggacggggaattaaccaaagaagagttgtcggtatttttcggaaggatgattgaggaacaggcggccttttcgcaggacgaggaaggaaacggaaactacaggaaaaagaatatagcggatatcctggactatattaacggacattatctggatgataactttactgtgaaatatatggcagcttgttttgatacctccgtatccaatctcagccatttctttaagaaaaacatgcaggtgagcatatcccagtatgtggagaagattaaactggagcgtgccaaagagcttctggccgacagtgataagaaaatttcagaaatagcccagctgctgcgttacggcaacagtacggtatttatagaaatgtttaaaaagtatgagggtataacgccgggaggctaccgggaaaagatatggaaaagcaggatgtaaatatatcgttttgatgaatggatacaggaaaagaagatattatgaaacggcgctgtatttttttcatgagaaggggataaagttcaaaagcatgagataggcagaaggcgcagactggggtatgctacatacatcttccgaagagccgccgcactgagggtgtttgatacggattcggaaaagcagcagatgtcagtatatttataggagggattgttttgaaaagaaaaacaatgacaaaaacaggagccatcttagtgagcgcggtgcttctgggcagtaccctggcaggatgcgcaggcaaggcagggacatccggtgacgtacagggggatccgaagcctgagacacaggcgcaggcccaggcggaagccggaggaaacacggacagcaactttaatgcacagggacttcccatcttaaatgaaaaggaaacctttaccattgcggttccacagagaagtaccttgaaggcggcttcccaaaaggcctgtgtcattgcggcagaggaagctacgaacgtacatatcgaatgggtggaaatcccccagtccggctggcaggaaaaaatcaatatcatgttcagcacggacagccttccggatgcggttctgggagatgtggatatagcgaggaattacgaacagctggcgccgctggatgaatatctggaaaactacgccccggcggtcaccgcattttttgacagcagggatgattatccggcgagtctgatcgcaccggacggaaagatccactgccttcctataggcgatgaatccactcagaatatcatcgattcccagttctggatcaatacggactggctggaaaaggtagggaaggaaatgccgcagactccggaggagtttaaagatgtgctgatcgctttccgggatgaggatcccaatggcaacggcgttaaggatgaaatcccgtttacttttgcaaaggcctggagctggggcacggcaatggaaaacctgttcggcccgttcggagttgtggaaaacgaataccacgtatttaccaaagacggaaaagtaaccttcagtgcgggggaacagggatattacgatgcccttgcctggatgcacgatttatataaggaaggtctgattgataaggatgttttcaccatgagcgatgaacagtattctgcaaggggagcatccggggatattatcggtgtcatggcaggctattccggggatgagtgcagcgtggacaacggtgcgccgggagaaggccgttacaaggcggtccctgtcctgaaaggaaaagacggaacacagatggtaggcatcaataacgtgacaaagacaggcggttttgccataagcagaaactgtaagaatccggaagcgctggtacgttggtatgattacattaattcttcactggaaatggcccttacctggggaagaggagccgaaggcgtgtggtgggaaatcctggatgaaaacggaaaagaagttcctgaattcctgaccatgacagccgaggtcctggaagctaacggcggctataaatcgattcctgaatatcggaatgcggaaagctttgcaggtacaactccttccctctggagaaatgaatacgatcaggcgctgcagtatgatgacaaatggcctcatgactggaagctgcaggcggttaaggaacagataccctttggcgttatcggtctgcccgcagggacggcaagcctggaaaacgcggagagaagagcgattctgatcgccgatatcgatacctatctgcagaagttcattgcggattcggttatcaacggcattgatgatgaaaagtgggaagcccatcttaaaaatctggaaaatctgaaggcggaggaatataccgcactttgtcaggaatatgtggattcctattccggaaagtagacggcaggaagaaagctggtcgtctgacagatagttgctgcaccggaggccggagtggtatgcctggtagcatattacccggccttttgtaagtttttcaatagaggaggagcattatgacaggctgtaggcctcaaagacagtacggcgccggcaggaaaaagggcgtccgcagaagcagtatgcggctgctgaaaaaaagctgggtgtgttatttatttatcctgcccatgattatatatatcgttttatttaactatcttcccatgtacggaatccagcttgcctttaaggattaccgggccctggatgggatctgggggagcccctgggtaggctggaagcatttccagacctttttcggttcataccagttcaaggatcttttatggaatacactggcgctgagcatttattctctggcggcaggattcccgcttcccattcttttcgcgctgttcctgaattatgtgaccaattccaaaggcaggaaggccgcccagatgatcacctatgcaccgcattttatctccaccgttgttttctgcggtatgattctgattttcctggcgagcgacggaatcgtaaaccagattctggccctgctgggaatagaaccggtggccttcctttccaatccgaagaatttccggcatatctatgtatggtccggcgtgctgcagagtataggctggggatccatcatgtatatatccgtgctggcctctgtcggtcctgaactgcatgaagcggcaagggtggacggagccacgaaattccagcgcatgctttatatcgatattccttccatcgttcccaccatggtgatcatgcttattatgagggcaggggaaatcatggatgtggggtttgagaaggccttccttctgcagaacagcgttaacctggattattcggagattatttccacctatgtatacaaaataggtatccagagcggccagttcagttattctgcggccatcgggctgttcaacaatataataaacctgattcttctgctggcggtaaaccggattgccggcaaagcgtcggatgtgagtttgtggtaagggggaagagaaatgcttttaaaatggaagaacaacaagtcggattatatatttacctttatcgtttatgccagtgtagttctcatttccctgctgattctgtaccccttgctgttcgttgtgatcgcttctgtcagtgatcccgatctggtggcatcgggacaggtgctgttctggccgaaggggattacactggagggataccgctatatcttccgggatcagaggatttggagcggttattataatactatccgctatacctttttcggcacgctgatcgcactgaccatcaccatcccggcggggtatgccctgtccaggacggatatggcgggacgcggctttgtgatgaagctgctgattgtcaccaaatatttttcaggagggctgatccccacctatctggtggtaaaggggcttcaccttgtgaatacgccctatgtgctcatgatcctcggttccttttccgtattcaacctgattctgtgccgtactttttttatgaacaccatgcctcttgaactgcaggaagcggcggaaattgacggctgcagtattttccagtattttataaaaatcgtcctgccgctgtccaagtccatcattgcaattatggtcctttactatgcagtagggcattggaattctttctttaacggcctgatttatgtgagcgatgccaagctatatcctctgcagctgattctgcgggatattcttataagcgggcagtcggtggatccgtcggtgagtgatccggaagccatagaactgatgaaacagatcgcaaggaccatcaaatatggcgtaattattgtttcttccctgccggtgctgatattgtatccttttgtacagaagcattttgtaaaaggggtgatgatcggttccctgaagggataaggagcgcgggaagaggaagagacaggcccggatcctatatatccggggtgcaggcttattatacgaggagaggcagaatgaaaaatgttttgataattatgaccgaccagctccggagggatgtgctgggctgctacggaggaaaagaggtggaaacgccttatatcgattcgctggcggaggaagggatactgctggagaactgttatacgcccagtgcggtatgtacgccttccagagggtgctttatgacgggaagatatccccataataacggggcgatttccaatggccgccctgtgggagcaaaggagcatggcttcgcagaggctttccgggacgccggatatgtgaccggttatgcgggaaaatggcatctgggggatcacagggagctgggggacagcctggaagactgcagccgcctggggtttgaccgctgggatcaccgggtggaattcgggcattgcaaatcggtgaaggaaaaggacgggaagcttattctgtcccgtgaggtgggggatgagcattcctataccacagactggctggcagatgaaacgctccgttttataaaggagcagaaagacggcaggccgttcctgttcatggtgagcatgccggatccccatcagcccttccgggtgcggaagccttacgataccatgtttgatccgctgcaaatggaaattccggaaaccttttatgaagaggagcttccggactgggcagaacaggacgaatggggacgccgtcattatttccccacagggctttttgaacgggaggatcacttccggcggctcaaggcccagtatctgggtgcggtgaaatgtatagatgataatgtgggtaagatactggatgggctgcgggaagcaaacctgctggaagagaccgttgttatttttaccacggatcatggtgaatatctgggagaacacgggctgatggaaaagaacaacctgtatgagagcgtgtatcatatccccatgctgctccgtctgccgggatgcggtaagaaaggcttccgcagccccgtctggctgcggatgacggattttgccccgacgctggcgggactgctcggcatcccctatcgttttccctgtgacggaggcgacttgtcggaggagcttatgaaaggcagagagggattgaaggaagtctgtatttttccaagtgatgttcccagaaccggtattataacggaggattatgagctggcctatgtgggcagaggataccacggcagtatgtttcacgaccatatcctgtttgataggaagcgggatcccatgcagcgggtgaatttgtttgggaggccggaatatgccggcattacggaggttctgacggaaaaaatcagggaatatcatagaaggtaccgcacgcccgacagcctgctcccggcggaagcccggaatttacaggaagattagctttttttgcataaacaatccctttccctgcatatattggtaacagctaggcaagcggaaggggattttatattatggacactttgcatacacaaaatttatacaaagacattcagcttcgtaccggcggagaaatctacatcggtgtggtaggacccgtgagaaccgggaaatctaccttcatcaaacgctttatggatttgctggtactgccttacatcaccgatgaagcggaaaaaatacgtgcacaggatgagcttccccagagctcgggcgggaagacaattaccacaacggagcccaaattcataccgaaggaagcggcccagatcacgctgagcggcgatgtaaacgtacaggtgcgcctggtggactgtgtgggcttcatggtggacggcgcggccggacacatggaagacgaagaagagcgtcttgtgaagacgccatggtttgattacgagatcccttttacccaggctgcggaaatcggtacaaagaaggttatcaatgaccattcaaccataggtatcgtggtgaccacggacggcagcttcggtgaactgaagcgggaaaattacatagctccggaagagaaaaccatccaggagctgaaaaaactccataagccctttcttgtactggtgaactcggaacgtccctatggagaagaggccatccatacggcagcccagatccaggaaaaatacaatgtaacggccattcctgtcaattgtgaacagctgaaacgggatgatatcaatcagatcatggagaaggtgctctatgaattcccggtgaccatgatagaattttatatgcccaaatgggtggagatgcttgccaatacccataagctgaaagcggatttaatcgataagatccgtacgctgatggacggcattgacaccgtgaaggatgttattaatacgcaggtatcggtagacagcgattacatcaagcgttgtattgtcgaaaagatcaatatggcggacggcagcattcgtgtggttctggatgtggacgataaatattactacgagatgctcagcgagctgatcggggaaaatgtatccagtgaataccagctcatttccgtactgaaggaaatgtccaggatgcgcaaggaatataccaaggtgcttcatgccatggaatcagtgaggctgaagggttatggtgtggttactcctgagagggcggaaatcaagctggataaaccggaggtcatcaaacacggcaacaaattcggcgtgaagatcaaggcggagagcccgtccatccacatgataaaggccaatgtaattacggagatcgcgcctatcgtgggaacacaggagcaggcggaggatttgatcagctacattgcggatgcggaaaaggattccgacggcatctgggaaaccaatatcttcgggaaaacggtggaacagctggtcaatgacggaattaccggcaagatttccatgatcggtgatgaaagccaggtaaagcttcaggagaccatgcagaagatcgtgaacgacagcaatggcggaatggtatgtattattatttgacagttcaagaaaaccggaaggccgacgccttccggttttttgcaggaagtcttcttttttatctagtttatctaggaatccggctgtgattctgctatactgatttcagaaacgggtttacatggaaaatactgtttttaatttaattaaaggaggctcatatatgaatcctgtatatgataaactgttaaaatgttacgaaagtgtaaagcagaaaatcgatttccgtccggaagtagccattgtacttggctcagggctgggcgattatgccaatgatatccgcgtggaggcggaactggattaccatgatattgaagggttccccgtatccaccgtgccgggacatgcaggaaagtttattttcggttatgtgggagaggtgcctgtggtgtgcatgaagggaagagtgcattactatgaagggtatcccatttccgatgttgtcctgcctacccgccttatgaagctgatgggggctgaggtgctgttcttaaccaatgcttccggcggcatcaatccgtcctttacggccggagatttcatgatgcttaccgaccatatatccctttgggcgcccaatccacttatcggcgccaatatagacgagctgggcgtgcggttcccggatatgacgcatgtatatgatgaagatctgcaggagctcatccgtgaagccgcaaaggaacagggaattaacctgaaggaaggaatttatgcacagcttacggggccttcttttgaatctcctgcggaaatcaggctgctgcataagctggatgtggatgcggtgggaatgtccacggtggtggaagccattgcagccaatcatatgggaatgaagatatgctgtatctcctgtgtatgcaatctggcagcagggatgacagacaatccgctcacccatgaagaggtacaggaggcggccaatgcggcggcacccttattcaaggcgctggtgacagaatcggtgaaaaaattcggagctgcgctgaaggcatgaaatgagccggggaaggaaccgtaccgggaggagggagagaatatgacggattacagaaacttgatcagcgaggcgatgaaggccagggagaatgcgtatgcgccttattccggcttttatgtgggagcggcgcttcttgccgcttttgaaaaggatgggaagccgcttatattcacaggctgtaatgtggagaatgccgcttttactccgaccaactgtgcggagagaactgcttttttcaagggaatcagcgaaggggtgcgtgcctttcgggcgatagccattgtgggaggaaaacagggggccgttacggattacactgcgccctgcggagtgtgcaggcaggtgatgatggaattttgcaatccggatacttttgaagtgattgcggcggtttcggaggatgactataaggttttcaagctgaaggagcttatgccggaggggtttgggccggataatctgtaggaaggaccggcagactccggatgaaatgcgaaattgatgttggatggaaaaggagacttactgaattatgaaaatacgcttatacaatgcccggattatgacgatggctgaagactgcaggctgttggaaggagaaatctgggtagaggatgacaaaatcctttatatcggggacggtacggatttggatgaattctgcagaaggacaggctgtatcggcctgatggccgatgaggaaatcgactgtgaggggaatgtgctgatgccgggcttcaaggatgcccatacccattccgccatggtggccatgcgttcctttgccgatgatatgccgcttcaggaatggctgaataccaagattttccctctggaagccaagatgacggagcaggacaattacgacctgacccagctggccatcctggaatatctcaccaccggagtgaccgctgtgttcgacatgtatttatctcccaaagatatcgcacaggcctgcgtggatatgggaatgcgctgtgtgctggtgagcggtctgaataagttcgggcctgcccttgaggtgatggaagagcggtacaataccctgaacggtatgcatccgctgatttcctatatgctgggtgtccatgcggaatatacctgttccaaagaattattggagcaggtgtccgaaatggtccataaatacaaagcgccgcttttttcccatatatctgagacaaaaacagaaacggatgaatgtctggagcgttacgggatgaccccgccccagttcctggattccctggggctgttcgattacggcggaggcggttatcattgtgtttactttacagaggaagatatggatctctttgcacggaaagggcttcatataatcaccaatcccggatccaacaccaagcttgcaagcggggttgcaccgattacccgtttcctggaaaaaggtattaatgtgggtatcggaaccgacggcgcttccagcaataactgcctggatatgttccgggagatgttcctgacaacagggcttgccaagcttcgggaaaaggatgcctctgcggtggatgccgaagcggtgcttaagatggctacagtgaatggggcaagagccatggggcttcatgactgtgacattcttgcggaaggcaagaaggcggatatcatcatgatcgatctgcatcagcccaatatgcagcctctgaataacatccagaaaaatatcgtttacagcggcagcaagcagaatgtgaaaatgactatggtaaacggaaaagtcctttattatgacggaaaattcctctgctgtgacgatgtggaagctctttacgcgaaggcgaatgaaataataaaacgtatcagtgcccagtaaggagaaccggatgaaatacaggataatggttattgaggatgatcctgttatcagagaggagttatgcatccttttaaaagggaacggctatgaggtgggggctgtgactgatttcacggatactctggagcagatcagggaatggcagccgcatctgctgctgctggacatcaatctgccgggagaggacggtttcagaatctgttccggcatccggaccttttctgccgcaccgatcatttttgttaccagcaggaatacggatatggatgaattgaacagcatcatgctgggcggcgatgcctttattaccaagccctataatgtggcgattcttctggcaaggatcgcttcccttttgaaaagagcctgtccttcgggagaggcggaggttttggagcaccgggggctgtgtctctatccggaaagcggcaggatggcttttgaaggtaaacaggcggaactgacgaaaaatgagatgaagatacttatttttctgttccggcatgcaggaagtatctgcccgcgggccgatatagtggaatatttatgggacaaccggctttacgtggatgataatgcgctgagtgtgaatatttcaagaatacgggaaaaactcgcggagctggggctgccggattttattcgtacaaagcaccgccaggggtatctgatatgagagggacggattatttcaaagaccggcttccccttcttatgcttcaggcgttcgccatgatcctgctggccctgtttcttttggcggtggggaatgaaggaagcacgataggtattattctggtctgctggctgcttttattaaccggctggctgtttgtggatttccgtctcagaaaaaagaagctggatcagctgctggccctggcggaagggctggaggagaagtatctgatagcggaggtggcgggaaaacctcacagggccgatgaccgtgtgtattaccggcttttgtccatggcgggaaaatccatgctggagcaggtatccgccgtgaaaagggagcgaagggaatatagggaatatattgaacagtggattcatgaaataaagacgcctctgaccgccctgaagcttctgtgtgataataataaatcggagatcacccgtaccatgctgcttgaactggagcgcctgaatcattttgcggggcaggcactttattatgcccgcagtgaaaccgtggagaaggattatctgataaaagaaacccttctgtcggatatcatccaccaggcggtgtcggacaacaaacagcttcttttgagcaatggggtgcagattcatctggaagactgtgagcataccgtttttacggatgaaaaatgggtgacctttattcttaaccagctgattggaaatgccgtccgttaccggcgggaaaatcctgtgctggttttccgggcattttgcacagatgacggcatttccctcagcatagaggataacgggatcggaatcccggccgatgagcttccccggatttttgagaaagggtttaccgggaccaacggacgtctgggaaagtcatctacggggctggggctttatttgtgcaggaggctgtgcggcaaactggggatcgggatttctgccgcgtcaggtgtgggaggtacggcaataactctttcctttatctgcaatcatttttgccggatgccggaataaaatagagtttaaatgacgggagaagcgcagggattctgcgcttcttacatttttgtaagaactcggaaagaaaaacagatacaaaccggtccgggcagctgttagaatagggatgcttcataaaacatgacgaaatggccgcccggcggcagaagagaggctgtatggaggatattttaaggatcagcaatatagagaaatactatggcagcggaggcaatctgacaaaggcgctttccgatgtgagctttcaggtccatgaaggggagttcataggcattatgggagcttccggttcggggaaaaccacgctgctcaactgcatttccaccattgatacggtgagtgcgggacacatttttctggatgggacagatgtgactgaaatcagggaaaaggatatagcccgcttcagaagagaaaacctggggttcatttttcaggaatttaatctgctggatacgctgaccgtaagggaaaatatatctcttgcacttaccattaaccgggttcctgccgggaatatcatggaacgggtggaggatatggcggataaactgggcatccgggatattcttgacaaattcccctatcaggtatcggggggacagaagcagcgctgcgcctgtgccagagcaatgattaaccggcccaggctcatcctggcggatgaacctacgggcgctctggacagtcattcctcccagatgctgctggatactatccgcaatatgaatgagagcctttcggcgaccatattgatggtgacccatgacgcgtttaccgcctcctatgccggaaggattctttttctgaaggatgggcagatatttaccgaaatactgcggggaaatgacagccgccgccgtttcttcggcaaaatcctggatgtcatgaccatgctgggaggtgatttggctgatgtacgttaagcttatctggcggaacgccagacgttccataggggattatctgatttatattgtgacactgactttgtgtgtggccatgttttatgccttcctatcgattacaagcagatattacaggccggatatcggcgcccagtttgatctgagcattctgggagaaaacatgagaaatgccatttgcgcgatcaccctgcttctgctttttctgatcaagtatgtcaataatttcatgatttacaggaagcagaaggagtttgccgtacagacgattatggggatggaacagaagcttattgccaggatgtttttctttgaaaccctcattatgggaggagtggccctgctgacaggctgccttctgggagggctgcttgcacagctgattacggcgatgcagctggcctctatgggatatccctatcggattacctggacgctgtatccggacaccctgcttctgacggcgcttttctttctggcaagctttgtggtgatcggtctttttaatataagagccatccgcagaattaaggtgatcgatatgctgcaggcggataaggtgaatgagtcacttaagaaaagcagatggatgcatggggttatttttgtattctcactgttcctgattgcggttttggcgaccggaatcagcaaaagatattattattttgatccgaggatgcccctgccggtgcatgtgatgtttgcggcaaatattgcggcgccggctcttacgcttttgcttccggttttcttccttttcagccgtctgaaacataaaaagcggaatattgcagcgctgacaggcagtatgctggcggccgatttgctgcttattgtgagcgcggccagtgtgcctgtcctccagcagaaatactatctggcgctcgggggtgggagtgtgaacctttatgccatgtttatcctcggggaaatcgtgtttgcagtctgtgcattcatgtatctgacgggaagctttgtgacagccataaaagaaaaaaacagtaaatgggcgtatcgggaagaaaacctgtttttcctgggacagatactgactaagctgaaaaccactaccaaaaccatgacgcttatctgcctgacattaatggtatccatcggcctttttttatccattcccgcccttgtaggctgggcatcaggatatctggaggaaagagcggtttttgatatacggatagcttccctctataaccagaccgggaatatagaggagctgcctgataccggatatgaatttgtgacggattttctggagaaggagggcattgctgttgaggatgattgtgtgatgtctctttatctgccgcggaaggagctgttttacagccggttgaaaagcgattttccggttcttgcgatatccctttccgattataatcatctgcgccggatggtcggacttgatcccatcagcctgaaggaggggacctttaccacacaatggcgttctacggcatcggaagaggatatggaaatattccttgatgacaatccgctcgtggaaacggatgccggtgtgctgaaacaggcggccgagagggcttatcatgcaggaataagcgaaaatgtctataacctgtatacggatgtggtttacgtattccctgacagcatatgcgggaagctgctgggggcggagaggcacagatatattaataccgccgagcccatgccttacgaaacctgcaccaggctggaaaccctgtttgagaagacgctgcctacggatacacagggagacggagttatttatctgatacggacccgttccgtggaggtgagcgataccacagcaggcaattttattattaaaacaggcatgacatatgcggctgtagtcctttttattatatgttttaccatactggcactgcagcagctcctggacagctctctttattccggccgttttggggtattgaagaagcttggggtggaggataagcatattgaacgccttatctttaagcagctggcattctggttcggacttcctgttggggcggcggcgctgggcgcggctatattcgcggtatattttttccgtacaatttccgttcagatcgccgcttatgtgggaaccggaaacctgatggcgcaggtgggggcggtggtgctgatactggctgtcctgctggcctgctactttaccagtacctggattttattccggaaacagatatttgaatgaaagccccggccggaggtgagatgcctccggccggtatttttgcagcaacttgcataaaatggcaaattccgacaattttataatagacattctgtatctttcagtatacaattaataacgtattctttcttaaaatacataattttaacacaatcttaggaggtaggagatgttagaaaagtttttcaagctgaaggaaaacagaaccgatgttaagacggagatcatggcgggtattaccacgttcatgacgatggcttacatccttgcggttaaccccagtatcctttccgcggcgggaatggatgccaatgcggtgctgattgcgacagcgctcgccgcttttgtgggtacggcaatgatggctttgtttgcaaactatccgtttgcactggctcccggtatggggctgaatgcctattttgcttataccgtagtcctgaacatgggatattcctggcagattgctttgatggccgtatttgtggaaggtcttgttttcatcgtcctttcactgacgaatgtcagagaagctattttcaatgccattcccatgactctgaaatctgcagtcagcgtaggcattggtctgttcattgcctttatcggcctgcagaatgccaaaatcgttgtaaacagtgatgccactctgctcacatatcagacatttaagggagataccttccattccattggtatcggtgctatcctggcgctgatcggtgtccttgtaacggctatccttcttgtaaggaagataaagggaggaatcctgttaggcattatcatcacatgggtgcttggcatcatctgtgagctgacaggcatttatgttcccaatccggatgcggggatgtattctgtaatcccttccgcaattgtaagctttgacttcagctccttcggacataccttcggacaggtattcaaagctgatttcagcaatatcagaattctggatttcatcgtagtaatgtttgcgttcctgtttgtagacctgtttgatactctgggcaccctgattggcgtggcttccaaggcggacatgctggataaggacggcaagcttcccagaatcaaaggcgctctgatggcggatgccgttgcaacgagcgtaggcgccgtattcggaacctccaccaccacaacctatgtggaaagtgcatccggtgtaaccgaaggcggacgtacgggccttacggcaattaccacaggcattctgttcctgcttgcactgattttctcacctctgtttttgaccatcccttcctttgcgacggctccggcgctgatcattgtaggcttctacatgatgggtgcggtggttaagattaatttcgatgatatggcggaagcaattcctgcattcctctgtatcattgcaatgcctcttgcatacagcatttccgaaggcatcgccatcggcgttatttcctggacactgctgaatctgctgacaggtaaggcaagagacaaaaagatcagcatactgatgtatgttcttacggtactgttcattttgaagtatattttcctgtaagacgcaaaagaaggacatttataaagaaaaacatttatatggaaggatccctgcggcaatatggcggggatcctttttcgatcggttatcatgcctgttctggacgctgtacagggaacggatccagggaaaagggcttgccggaggcagccggaatattggattttaaaaacataaatttttataaattttccgggaaggataaacaggaagaaaaatgtgtggtacaatatcccggaaaccatttgaacaggtaagggagtggcggtatgcataatcaactgaccgaaaatgacataaaacgaatgaaggaagagatagagcaccggaagctggtggtacgtaaggaagcgctggaggcggtgaaggaagcccgggcccagggggatctgagtgagaatttcgaatactatgcggcaaaaagagaaaaaaacaggaacgaaagcagaatccggtttctggaaagaatgataaagactgcggaaatcatcccggaggattccaaagaggatgaggtgggtgtaaacaatacggtggagctgctttttgaagaagaccagacagtggaaaagataaaaatcgtcaccactatgcggggaaattcgctggaagggcttgtcagtacggaatcacccatcggcaaggcgcttctgggacataagacaggagatcgggtatacgtggaggtaaacggcagctacggttattatgtgctgatccgcgctattgaaaaaacagtggatgacggttcggataaaatcaggagcttttaggcggcatgcggctataaaacggaaggacggaattatgaaaattacgtatattgcgcacagcggtttttcagtggagcttgaaaaacaggtgctgctgttcgattattttacaggggaactgcctgtctgggataaacagaaaaccattttggtatttgcatcccaccggcatcaggatcattttaatatgaagattttcagcctgcgggaacaatatccccatattcattttttcttcggaaatgatattaagctgagccgggcccagatggttcataagaaggcggatccggaagctctggaggatgtgacatccttgaaggcccatgagagtctgacatatggggatggtgacggcgctgtgagaatccgtacgctgaagtctacggatgaaggagtagccttccttgtggaggcggaaggaaaatcgatatatcatgcgggtgatctgaactggtggtattgggagggcgagcctctgtcctggaaccggaacatggaggtgaattataagagggagattgacagcattgcaggttcttttttcgatgcggcctttgtacctcttgatcccaggctggaagcagccttcggttatggaatggattattttcttcagaaaacggatgcggcccatattttccccatgcatatgtgggaggaatacggatacattgccaaatacagagaaacggaaacaggccggccatacgcggatcggattatggagataaaagaacgcggcgacgtgtttgaaatttaggcagcaggaaggagagaaagcatggaatggctgacagtagtggcaatcgtaatcggagtggttcttgccatatttctcaagggggcgtttgatgagaaaagtaaaaagaaacggctgaaatggctgatacatgacagatatgggaagacaccggacagagattatggggatgaggagctttccagtattccgggttatttttctgcgcatcagaaaaaaggacagattgacgacattacctggaatgatttgggaatggatcaactgtatttccggatgaaccatacctattcctcagcggggcaggagtatttgtattatatgctcaggacacctgaaatgagggaaggagagatggaaagcgaaatgttgttttccacggaaaaagaagttctgtcttccacggaaaatgaaatgccggcatccaaaggaaacgggacgggcaattccgggaaaacgggcggacggatatccatggaagagaagattgcatacttttccgaaaacgaaaaagagcgggaggagctgcagtacgctttcatgcagcttggaaggagcggtaagtattccgtttatgattatctggaatatctggataagttgggtgaatccagcagtttaaccgctatcgtgatcgatctgctttttatcccggcaattttgactatgatcgcttctccgccttttggcatgctgtttttgttcacgctgatttccattaatatctatagctatatgaaaaagaagcaggagattgagccgtatcttaccagcttcgcctatgtacgccggatccttgatttctccaaacagcttgtatctatggatattcctgtgctgaaggaggaatggaagcgcctgaaggaactggaaggaaggtttggcaaattccgctacagcgccatgctggggatgcgcggaagcagtatggcgggtgatcctctttccattttactggattacgtcaatatgcttctgcacctggatatcatatgctttaattccatgctccgcgaggtgaaaaagcatatgaccgatatcgacaggatgattaccataacgggaagagcggaatgctatatagcgatatcatcctatcgggccagcctgcaccagggttggtgtgttccctgtttcgaaacgaacggcaggatgggaacctgtggtcatctggaattaaagggcttatatcatcctttgctggaggaagcggttaaaaatgacatctgcgtggagcagggcgtgctgcttaccggttccaacgcctccggtaaatccacttttctgaaggccgtggcagtcaatgcgctgctggcccagacaatcaatacctgcgccgctgatttctatcagggagatcggtatcagatcatgacctcaatggcccttcgggatgatttggaaggcggcgagagctattatattgtggaaatcaagtctctgaaacgtatccttgatgtcgcgaggcaacatgaagagaatcccagaacgaatcctgttctctgttttgtggatgaggtgctgcgcggaaccaatacagtggaacgtattgccgcctccacgaagatactccaaagccttcacaggccgggagtcctctgctttgcggcgactcatgatatcgagttgacggaactgctggcagaatgctatgataattatcattttgaagaagaaattgaggaaggtgatatccttttcaattatgttctccgaaccggcaaagcggtgagccgcaatgccatccgcctgctggggattatcggatatgaagaggcaattattgaagaggcggaaggcctggcttctcattttctgaatacaggaagctggacataaagagggagagtctatggatgtaaagatttttacggacggtgctgcgcggggaaatccggaagggcccggcggatacggcgccatattgcagtatgtggatcagaagggaatgcttcatgaaaaggagctttccggaggatatgtgaaaacgacgaataaccgaatggaactgatggcggttattgcagggctggaagcgctgaaccgcccctgccgggtagaggtgatttcggattccaaatatgtgacggatgcttttaacaagcattggatagacggctggctgaagaaaaactggaagggagcttccgggccggttaaaaatgtggatctgtggaagcgccttctgaaggcggccgaacagcataaaatcacatttacctgggttaagggacatgacgggcatccggaaaatgaacgctgcgatgtgctcgcaacctctgcggcggacggggacgggctgctggtggatcccggggtgatgtagttggggatacaggttattagcaggttcccatgcggccatattcccccaatttattcgcttcctgaatttgattttgcagtaattttattacagattttgcgacgattgtattacattgacttgctaaacgcacacaataatgatataatgatgacagatagaatacaaaaaggagatgattacatggcacagtcaactataactgcacgagtagacgaaaaggataaagtcaattttgacgctttttgctccaatgtcggcttaaacacttctacagccatcaatctttttgtaaaagcagttttacgtgaaaatcgaattccatttgaaatcacacaggctgtcgatccatttttttcagaatccaacctggcctatgtgaaaaaatccgtccaggaactccgggaaggaaaaggtacggcacacgagctgatcgaggtagaggatgagtgaaaaaatctggtcagatgatgcatgggaagactacatctattggtagacataggacaaaaaaataataaaacgaatcaatcagctcattcaagatattgaacgcaatgggtgcatgagcggaatcggtaaacccgaacctcttcagggagctctccaaggtgaatacagccgccgtatcaatgagaaagaccggctggtttaccatatggaaaatggacgcatctacattgcacattgtagaggacattacggagataagtaattacgcataatcctcacttttgcttttgttaaaagccgatcaatgtctttcgctgaaagcatatgtaacatttcaggtatctgaattgtttcaggtatacaatatacagcatgaaaatgaagcattggatacttgacgcgtccgccggttcaatggtatgatggacaaggtaaacggtcgggtatacggtgtggaaatctgcaggacagtaggtcagacaaggggttggaaaaatggctaattttacattgttttttaattcatttttatcttatttgcttctttttatcttgattgttattttaggggtaatagcctgctttatcggtatcaatctgcgtaagaagaaggatgccaaggatgcggcggttcaggagagtaccggtaacgggcagtcctgacggaagaaaagagttaacgtttttattaaccaaaagagtgggggatcccgctcttttttgtgagtggtgcggggttaaatatgccaaaatcatctaatcagaagctgaaactgctatacctgctcagaatattgcagaaggagactgatgaggagcattacctcaattcccagcagctgatcgaacgcctggaaaaatatgatatcagtgcggaaagaaaaagcatttatgatgatattgcgcgtctgacagatttcggctacgatattatacatgttaaaaacaaaagcggaagcggctattatatgggaagccgggagttcgagctggcggagctgaagctcctggtggatgttgtccaggcctcccgttttattactctgcgcaaatccagagagctgattaataagctggaacagtttgtcagcggcaaagaggcacagcagctgcagcgtcaggtttatgtggcgggccgggtaaagaccgataatgaaagcatttattataatgtggattttatccatcgggcgatacaggaaaacaggcagatctcgtttcagtatatggagtggacgctggataagaagcttgttccgagaaagggcggggcaagatatgtgatcagcccgtgggcgctgtcctggaatgatgagaattattatctgatcggctatgacaaagaagcggatctgatgaagcattaccgggtggataaaatgggatccatcgagcttacccgggaagaaagacagggaagcagcgtttttgaaaattttgatattgccgtttatacgaataaaaccttcgggatgtacgggggcagggaggaaatcgtatccctggtttttgccgatcaattgattggagtggtactggatcggttcggcagggaaaccgatataagaaggctgcaggaaggcaccttccgtgtacgtgtgaaggtggcggtcagcggccagttttttggatggcttaccgggcttggaacgcaggtacggcttgcaggaccggaaaacgtagtggaagaatacagaaattatctgaaaaaaatatacgatcgatatgaggaaggctgttcggggcaatgatgtgccggcggcagaatggaggaaatcatggagcttcgttttgcatccagaatgaaggattacgaagaaggcattttccaggtgctgaatgaaaaaaaggaagaactggtgcgggaggggagaacggtgtacaacctttccgtaggaacgccggattttcagccgcagcaggcgataatggatgcggtggcggaggctgcgcgtaagccggaaaattataaatatgcgctgcgggatcttccggagctgacagaggctgttatcagccgttataaaaaaaggtatggggtggagctggaaccggatgaaatcatgtctgtatatggttcccaggaaggtattgcccacattggcctgtcgctgtgtgacagggaggatatcgttctcgtgccggatcccggttatcctatttttgcgataggcccttctctggcaggcgccaggctgatgacctatgacctgacagaggaaaaccattatctgccggatctggaggccctgggcgggctggcggataaagccaagttcatgatcgtatcttatcccatgaatcccatctgtaaatgtgctcctcacagcttttatgaagaattgattccctgggccaaaaagcatgagctgatcatcattcatgacaatgcttattcggatattatttatgacggaagaaaagggatttccattctttccattccgggtgccaaagaggtgtgcgtggaattttattccctctccaaatcctttaattatacgggagcgcggatgggcttcctgaccggcaacagggaactggtgcagaactttaagaagcttcgttcccagatagattacggaaccttcctccccgtgcagtatggtgcgattgcagccctgaccgggccggatgaaccggttctgaagcagtgtgaggaatacaggaaacgcagggatgcgctctgcggaggattccgttccatcggctggaatgtgccggacagcgaagggaccatgtttgcctgggcgcccattccggagggctttgaagatgatacggcattcgtcatggagcttatggaaaagacaggcgttttatgtacccccggcagcagcttcggagagttgggaaaagggcatgtacgctttgccctgacgcttcctgtggagacgattacagaagcggtggaggccgtgaaggaaagcggaattttggcaaaataacgaaaaaacagaaaagccctgccaggtgttgacagagaggttttattctattatacttgtatctgcatacaagatatagtatgcagactgctgtgaatgacaggatgtagtatcgttctgccgaaaaaaatcaaccggttattctgtttcccgcaaggaaggcaggaacggatgaaaatagaaaaagcgacgcataacgtatgaccggttgcgggaaatgtgccgggcgccccataaaggaggcgcttgctgaagcagtttcctgcaggccggattttttacccgtatttgcgctgctgctgcagttggatgagatgccggaaagcatgaaaatgccggtccggcggacaggcttatgtgccgcaagggcatggacaggagagaaggctggttgaaattttcagcctttgaattttcgtctgcgggaaagccgcaggcaggagggttagaatatggaagcgatggtacagggaatgaaagaaaatgagagtcaggattacggcagtgaatatcagaccaggctggacgtgaaggtagtcaagaaggacgggacaagagaatcctttaatgtgcagaaggtagtcaatgcggtaggaaagagcgcttaccgtgcccttaccaaatttacggatgaagagaaaagaaaaatatgctgctatgtgattgaaaaggtggatgagctggagtgcagcgaaattcccattccggtcatgcataatatcgtggagagcgcattggaggaggtaaagcctatcgtagcgaaaagctatcgggattaccgcaattacaagcaggattttgtccgcatgctggatgatgtatataagaaaagccagtccatcatgtatatcggggataaagaaaacgccaataccgattccgcgctggtatccacaaagcgaagcctgattttcaatcagctgaacaaggaactgtatcagaagtttttcatgactacggaagaaattcaggcctgcagggacggctatatttatgtccatgatatgtcggccaggagggacaccatgaactgctgtctgtttgatgtgcagaatgtgctttccggcggttttgaaatgggaaatatctggtataacgagcccaagactctggatgtggcctttgatgttatcggtgatatcgtgctcagcgccgccagccagcagtacggcggatttaccgtgcccagcgtggatttgattctggaaccttatgcacgcaaatcttatgaaagagatctgaagaaatatattgatctgggagtacctcaggataaagcggaagaggtagcctataaggatgtggtaaaggaaatggaacagggcttccagggctgggagtataagttcaacacggtggcgagcagccgcggggactatccttttatcacggtaacggcaggaaccggcaccggacgttttgccaagctggcaaccatgtctatgctgaatgtgcgccgggaaggccagggaaaggaaggcttcaggaagccggttctgttccccaagatcgtattcctttatgacgagaatctccatggccccggaaagcctcttgaggatgtgtttgaagtgggtgtgaaatgctccgccaagaccatgtatccggactggctgagcctgaccggcgagggctatgtggcgagtatgtataaaaaatatggcaaaatcgtttctcccatgggctgccgcgctttcctgtctccctggtatgaaaggggcgggatgcatcctgcggatgacaaggatgttcctgtatttgtgggacgtttcaatattggcgccgtgtccctccatctgcctatgattcttgccaaagcaagacaggagagtcgggatttctatgaggtgctggattattacctgaaccttatcagacagctccatatccgtacctatgcgtatcttggagaactgcgtgcttccactaaccctcttgcgtactgtgaaggcggcttcctgggcggaaatctgaagctctccgataagatcaagcccctcctgaaatcggcaaccgcatccttcggcattacggccctgaatgaaatgcagatgctttataacggcaaatccctggtggaggacggccagtttgcattggaagtcatggagcatattaacagcaagatcaatgaatacaaggaagaagacggcaatctttacgctatttacggaacgcctgctgaaaatctgtgcggcctgcaggttaagcagttccgcaataaatacgggattgtagaaggcgtatccgacagggaatatgtgagcaatagctttcactgtcatgtgacggaggagattactcccattgaaaagcaggacaaggaaggccggttctggaacctctgcaacggcgggaaaatccagtatgtgaaatatccgatcgattataatatggaagctgtaaaaacccttatccgcagggctatggaaaaaggcttttacgaaggcgtaaatctttccctggcttactgcgacgactgcggccaccaggagctggaaatggatgtatgccccaaatgcggaagccataaccttaccaaaattgacaggatgaacggttatctgtcctactccagagtccatggggacaccaggctgaacgatgccaaaatggccgaaatcgcggaaaggaaatcgatgtaacatgcgctaccacaatattaccaaggatgatatgctcaatggagacggcctcagggtggttctctgggtgtcgggctgcgagcattgctgcagggaatgccagaatcccataacctgggatccggaaggaggcctgccctttgacgaggcggccagacaggaaattttccagcagctggataagccgtatatttccggcatcaccttttccggaggggatcccctccatccggccaataagggggatgtgcgtaagctgatgaaggaaatcagggaaaaatatccggacaaaaccatttggctgtatacaggcgatgtatgggaacatttatataaggattccattttgcagtatgtggatgtactggtggatggagagtttgagatagaaaagaaggatgtcaagctgatgtggaagggaagctccaaccagagggttattgacgtacaggcctccctgaaacaggaaaatccggcccggccagttcttcactgcccggattatgcttctgctgaagacgcatggcaggatacatcggacggacagaatgaaaggagaacaggatgcggagaatagccagattcatgaaagtgagcagagaacagttcctctctgattttaaggattccttccccgaatacggagaggaacagattgtaaaaatatatgaggaactgaagctgcctgccagagcgaccagcggcagcgcgggatacgattttttcacaccggttgcgctggaactgaaaccgggggaaaccattaagattcccacgggaatccgggcttccatgcagccggaatgggtgcttcatttatatccccggagcgggcttggttttaaattcaggcttcagctcaacaatacggtgggcattattgacagcgattatttcaacagcgataatgaaggccatatctttgcgaagataaccaatgattccaatgagggcaaggttctgacgctgcaggccggggaaggctttatgcaggggattttcctggaatatggaattacggaggacgacgatgccgacggcgtaagaaacggcggcttcggaagcacaacacagaacgtataaacaggctcctttccggacaaactatatctatatgtccggaaaggagttttgtatatggcaagtgaagcgacagattccaaggaaaaaatggcgacaagcctggaagccaatatgctctacatgaacaaggtcataaaggcggataaaaatttcgatgtgatataccgggtcatacaggtcggcggaaaaaatgcctgtatttacctgattgacggtttctgcaaggatgaaatgatgcagaagctgctgcagcattttatggatattacagaggataacatgcccaaggacgcccatgaaatgtcgaagggctttgtgccttacgtggaagtggatcttaaggatacatgggaggaaattctttacagcctgatgtccggcgtatttcttctttttgtggacggttttgacaaatgcatcctgatagattccaggacctatcctgccagaggagtggaggaaccggaaaaagacaaggtactcaggggatccaaggacggttttgtggaaaccattgtctttaatacggcgctcatccgaagaagaatccgctccacagatctggtgatggaaatgatgcatgccggaaaaacctccaaaacagatatcgttctctgctatatggataacagggtggatcatgcttttttggaaaaaatcagggacaagataaaaaatatccaggtggatgccctgacaatgaatcaggaaagcctggcggaatgcctttatgacaggagatggtataaccccttccccaaatttaagtttacagagcgtccggatacggcatctgcgcaggttctggaaggcaacattgttattcttgttgataattctccttccgtattaattatgccgacttccatatttgatgtggtggaggaggcggatgattattatttcccgcccataaccggtacgtatctgagattttcccgttttattatcgccctgcttacttatctgatgacgccgactttccttcttctgatggagtaccctcatttgataccgaaaggctttgaattcatcatggtgagggatacggtgaatgttccccttatatggcagttcctcatattggagctggctatcgacggcctccgtctggcggcggtgaatacgccgaatatgctgagcacgcctctgagtgtcatggcagcgctggtgctgggtgaattttccgtcaacagcggctggttcaattcggaggtcatgctgtatatggcttttgttgcgatcgccaattatacacagtcgagctatgaattgggctatgccctgaaattcatgcgcataataaacctgatactcacggcggttttcggagtgtggggatatggtgcaggaattctgctcaccgtcattttcatggtgaccaaccgtactgtttccgatcagagctatatttaccctgtagttccgttcaatgccaaacagcttgcaaagcggctgttccgcctgcggctccccggagcgctggatcctgtggataaaaaggggaataagtaaaatcagcacaaaccatacacggataaacagatattttcatgcgccggcagcccgcgaggggaaagggccggcaggaaagtatctgtttttttattgtgcgcagggcacacccatgctaaaataagaaagaaataatacggaacggcgaggaggaagagaatggctgaatttaaaatcataacagacagtacggctgatctgcctggagaatacatagagcagaatcatctgggaatgatggttctgccttatattgtgaacgaagaaccctatggtattgacaaagaaatggatgttaaggaattctaccagcagatgcgtggagggatgatgcctaccacatcccaagtgaacccggaaacggcaaaggaatatctggaaaattatctggaagaatgcagcgagcttctggtactcagcttttcttcaggactgagcggaacctgcggaaatgtatttacagcagctgcggaaattatggaagaaagaaaagactgcaggattattgttgtggataccctttgcgcctccctgggagaagggcttttggtccacaaggcggtggagatgaagaaggcagggaagagcctggatgaaaccgcggaatgggtggaaaagcataagctgaacatggtgcatgtttttacggtagatgacctttttaacctgcacagggggggacgggtgagcagggccactgctattgtgggcacgctggcgtccattaagcctctgcttcatgtagatgatgagggacatctggttgctgtgggaaaggtccgcggcaggaagaaatccctgaacagtctggtggatatgatggaaaagcaaatagggagcttccgggataaaaatgactgctttttcatcagtcatggcgatgcactggaagatgcggaatatgtccgcgatctggtgaaagaaaaattcggtatcagtgactgtatgataaatacaataggccctaccatcggagcccattccggtccgggaacagtcgctttatttttctttggggataacagataaaaagggtagtatgccggaggctgataagcaaagacagggcccgggccgtaggacccgggctggtttgagaaaattaatttttgcacttatcgaattcaggattgaaggcatagaagtttttgctgtcaagtttatcctggacgatgcggagcgcttctccgaaacgctggaagtgaacgatttcacgttcccgaaggaaacggatgggagcggcaacatcaggatcctttatggtccttaaaatgttgtcgtaggtagtgcgggccttttgctctgcagccatatcctcagtcagatcggtgatgatatcacccttggactggaattcacaggaattgaaggggattccgccggcagcctgaggccagagggcggtagtatggtcaatataataagggccgaagccggagttttcaatttcttccatggacagatttttggtcagctggtaaacgatagctccgatcatctcgaaatgcgccagttcctcggtccctatgtctgtgagcagacccgaaacttctctgtacggcatggtataacgctgggagagatagcgcatggaagcgcctaattctccgtccggtccgccgtactgggagatgatgaactgtgccagctttgcattgggttccgtgattttaatcgggaactgcagtcttttttcataattccacatttacgcttcacaccccttcccatggaagaggcgccaggccccaattccattctctgttattaggatccacagttgccaggttcagcggaaaatacttgtcggcaaattccgcagacattttattcagcatccggttgtaatagttgaaataattcagcgcttctctgtcaaagggatgggtatccagatattcggtgagctctaccactacaaagcttactatgctgatgttgtgcaggctgtgttcctgttccgggttcgcgcagggagggcaattctgacaactcattttacacatctccttcctgtaaagggtttgatcaattcaggaaagatagtaccgcatttaaaagcctcgtccagatcctcacagatgttggtcatatgctgccaggggacataagccatggctatgggaaactgttcaaggcgttcgtcatagttataatcctgcataaaactcctctcatatactacattaatatttaataatataatatgtggagggtttgttttttgctacttaataacgcccgctttcatgctgttcattcagccagcggatcaaatcaggcatggagtcaggcgtattcgggaattctctggtgattttctgatcctccggtgtttttacaaaacagaatttatccggatatacggtggccgaaagctgatctccttttttctcaagatagtagcgcattccctgatagcttcctgtctgcgcctccttctgaataaaattaaaagatatttcttctttttttatcataataatctcatccctttcttttctccaggttaaaaacagtatagcatttcttttcccgaaagaaaatctctttccctgcaaaggaaggttgacattttcaaaccggtagaatataatcctaattgagaatgattatcaaataactgcagaggaaggacgaagctgtcatgacactctatgaagggcgggtaggaggccagtaccttgtggaagatattaagatagaatctgaaatatcaagaagactgcaggcactgggcttgatcgaaggaacgagactgaaaatgctgaaccgcaaagggaatggttcgctgattatttacgtgagaggaacacggctggccctgggaagacatatcacctccggtattgatgtgaaggaggcggaagagattgaggaaggataaccatgtgcatgtggcgtttgtgggcaatcccaactgcggaaagaccacgttgtttaatgcgattacgggttcgaagctgaaggtggctaactggccgggagtcaccgtggaaaaatacgaagggaatctgcaatatgaaggttatgagctgaagctggtggatacgcccggcatttattccctgacttcctatacaattgaggaaaaggtgacgcgcagatgtgtgctggatgatgatatcgaagtcattgtcaatgtggttgacgcttcctgcctggaacggaacctgtatctgacattgcagctgctggagcttggaaagccggtgattctggctttaaacatgatggatatcgtgaaggaacgggggatggaaattgatctgcaccgtctgcccgaaatgctgggggatatcccggtggtgcctgtttccgcggcaaggaggacgggcctggatattctcatgcatgcggtggtgcaccattacgaggaaggcccgaagaaggatatcctggattatggagaagaggtggaggagaagctttcggaactggaagaacgcatgcagtcctgttatcccgatcattcttccatccgctggcatgcgataaagcttttggaggatgatgaggaagtgaagaaggatcatccactggaagtggatgcccttgcagaacacagctatgaaaaggtaattgcccggaaaaaatacgagtatattgagaaaataatggaagaggtgcttttttataaggacaggaaagcggcaagcacggatcggattgataagatcatgacgcatccggtctggggtgtcccggtttttctgtgtatcatggcgctagtattttttctgacattttttgtgggggattttctgaagggcggactggaatacgcgcttaccattttttcggatttggtgagggcaggtctggaagggcttcacgtgaccgggtggatgatttcccttgtggtggatggggtaattgccggtgtgggaggtatcctgacctttatccccaacatattcatcctgtttctggcgcttgccattctggaggacagcggttacatggccagggtggcctatgttatggacgggattatgggaaaggtggggctgtccggcagggcgtttcttcccatggtgctgggcttcggctgtacggttccggcgatcatggcgacaagggcgctggaaacggagcatgacagaagaaggacaatgatagtaacgccttttatgtcctgttcggcgagactgcctgtctatgtcctgttttcagggatgttttttccccgatgtgccatgcttgttgccttttccatgtatgtcatcggtatggcagcgggtattctggtggcctttgtccagcacaagctggaaaagggaagagtcaatcagtcgctgatgatagagcttccggaatataaaaggcctaatgcaaggacaatccgtacctatgtgtggaataagctgaaggattatctgacgaaggcgggcactaccatatttattgcatccattattatatggtttatcctgaatttcggggttcatggcatggtgacggatccttcggaaagctttggcgccgctctgggccggttcctggtgccggtattaaagcctgccggactgggactgtggcagatcgcggtcgccctgatatccggaatatcggcgaaagaagtggtggtttcctccttttccgtgttattcggagtttccaatattaattcggctgcgggtatggccgccgtcattgacaatatccggcggtttgatccaaccttcggcgggttaaatgctttctgcctgatgcttttctgcctgctttacgtcccctgtgcggcaaccctggcaaccattaaaaaggaaagcggttcctggaaatttacttcggcggtcatggttttccaaatcgggctggcatggctggtgagtgtgctggtatttcagatcggcagtatttttctctgatataatcttgatttaacggtcaatttgtgtaaaaataggaaaagatggaaaagctaaaacatggcagctgtatagcgggtgccatgttttgcggttgaagaaaaaagccgcattgattataaatacaggaatggaggacgcaggtgagaggaattgacacacaggtaaggcaaatccgcaggcgtgtttttaaggaaatagccaatctggcgtatacttcggagaatctgaaggatgatgtggaagccctgccttataaaatagtaggagcggaagccccggcttacagggacagtatttacagagagagggcggtggtaacggaacgtatccgtatggccatgggactttccctccggccggagaatgtgccggtccatctgacccaggggctggacgagagtaatatcgatcagaaatattatgaaccgccgctggtacaggtgatcccgtctgcatgcaatgcctgtccggtgaatcgttacgtggttacggacaaatgcaggggctgtatggctcatccctgccaggaggtatgccccaaggaagcggtctctatggtgaacgggaagtcccatattgatccggaaaaatgtatccggtgcggtaaatgcaaggctatctgcccttacgacgccatcagccatcaggtgcgcccctgtgccctggcctgtggtgtgggtgcgattgagagtgatgaacagggccgtgcggtcataaatgaagaaaagtgcgtttcctgcggacagtgtatggtaaactgcccgttcggagccatagcggataaatcccagatcttccagctcatccgggctattcagtccggaaggaaaatcatcgcccaggtagcgcctgcctttgtggggcagttcgggccgggggtgacgccggatatgattaagacggcattaaagcagctgggctttgcggatgtatatgagaccgccatcggagcggatatcggagccgctgcggaagcggagcattatgtccatgcggtggcgacaggggagcttccctttctgctcacgtcctgctgtccatcctggtccatgctggcaaagaagttctttcctgaaaccattgacaatatttccaatgcccttacccccatggtggctaccgcgcgcaagatcaaagcggagcatccggacgcttccgtggtgttcatagggccctgtgcatccaagaagctggaggcatccagaaagagcgtgcgctcggatgtggattttgtcatcacctttgaagaactggcaggcatgtttgatgccagagggattgaactgaaagggattcaggcggaagataagctggaagacgccacaggggcgggccgcggctatggtgtggcaggaggcgttgccagtgccattgaagcctgtatccgggaatattatccggatgtggatgtgaatatcgaacatgcggaaagcctggccgaatgccggaaaatgctgatgctggcgaaggcagggaagaaaaacggctgcctgatagagggtatggcgtgtccgggaggctgtattgcaggagcaggaaccaatattgcaattccccaggcaatgaaggaagtaaatgccttcaagaccgctgcggagaagaaaatacctgatatttccgcggcagaagaagaaaaagcacttatgaaaaaatgagtaagaataataaggaaagcgaaggataagacaagtgactaaaataagaacccgttttgcaccaagccccacaggacgtatgcatgtgggaaatctgcgtactgctttatacgcctatttgattgccaagcatgaaggcggagatttcattcttcggattgaggacacggatcaggaacgtttcgtggagggggccgtggagatcatttacaggacactggaaaaaacaggccttaagcatgatgaaggcccggataaggacggcggtgtcggcccttacgtccagagtgagcgccaggcgcagggaatttatctggaatacgccaggaagctggtggaaaaaggagaggcttattactgcttctgtgataaagagagactggctacgctgacccgtacggtggcagggaaagagatcaatatatatgataagcattgtctcagcctgacccgtgaggaagtggaagaaaagctggcggcgggtgtgccctatgttatccgccagaataaccccaccgagggaaccacaaccttccatgatgaaatttacggggacatcaccgtggacaatgcggagctggatgacatgatcctcatcaaatccgacggatatcccacctataattttgccaacgttgtggatgatcatctcatgggcatcacccacgtggtgagaggaaacgagtatctttcctcctctcccaaatataacaggctttatgaagcgtttgggtgggaggtgcctgtatatgtgcactgtccgctgattacggatgaggagcatcataagctttccaaacgctgcggccattcctcctatgaggatttggtggaacagggctttctgacggaggcgattgtgaattttgtggcgcttcttggctggagcccggaaaataatgaagagatcttttccctggaggagcttacccgggaattcgattatcgtcatatgtccaagtctcccgcagtttttgactatacaaagctgaaatggatgaatggggaatacattaaggccatggattttgacaggttttacgggatggccgagccttacctgaaaaaagcgcttcccggaaatctggattacaaggccattgcggaaatggtgaagaccagaattgaagtatttccggacattgaggagctggtggatttcttcgcgaagctgccggaatatgatgtggcaatgtatacccataagaagatgaagaccaacagtgaaagctctctggaggtgctgactgagctgcttcctcttctggaggcccaggaggattacagcaatgatgcgctgtatcagacactggtgtcttatgtggagaaaaagggatgtaaaaacggttacgtaatgtggccggtccgtactgcggtttccggaaagcagatgacgcccgcaggagctacggaaattatgtctgttctgggtaaagaggaatctcttgcgcgcatccgcgtggcaattgagatgctgaaaagtgcctgtgcataaccttacggaaagtaatggagccaatcgcggccaatgggaagcgatccggcacggaagcgggcccctgcttgttcttgcagggcccggttccggaaaaaccttcgtcattatccggagaattctgcatctcgtggaaaacaggggagtggatccatcctccatccttgtaataacctttaccaaagccgcggcaaaggagatgaaggaacgtttttctgcaaatacggatgggaagcattatcccgtaaatttcgggaccttccatgccgtctattatcacattcttaaaacctcttatcattaccattccggtaatattatttccgattatgaaaagaaagaaatcctgaaaaccatactatcctgtccctcctgcccttatccgccggcaggtcttgtttccgtgaaaagcacagcttccatggatatatccatagatcccctggcggcggcagatgaaaatatagataatctcctggctgaaatcagccggtttaaaaataatgggtgccgtcaggaaaacgcaggagagcagcaggaaggatttcccgcaattttcaatgcctacgaggaagaactgaagcaaagaggaaagctggatttcgatgatatggtgctcaagtgccataagcttctcaccgacaggcctgatatctgcaaaagctggcaggaaaagtttaagtatatcctggtggatgaatttcaggatatcaaccctgtccaatacgatgtgctgcgtcttctggccctgccggaaaacaacctgtttatcgtgggagacgacgatcagtccatctatgccttccggggagccaggccggaaattatgctggggtttctgaaggactacccggatgcgggtaaggtacagctggaaatgaactaccgcagcacgcctgaaattatcagaagcgcgggacggcttatttccgccaataagaaccggtatgccaaaaaggctgtggctgcggcccgggaagggcagccggtcatcttccggggctttgttacaagagaagaggaaaatgaggagatagcgaaagaaatagcggagagaatggctgtgaccggggaaaagccgggggaaacggccatcatttaccggacgaatcaggatgccagcgcgatggccgccaaactggccgaaaaagggattccattccggatgagagaaaaaatcaaaaatccttacaggcagaagataccccaggatattctgtcttatctggaatttgccctgggagggcagtacagaaaggacttttacaggattatgaacaagcccctgcgttatatcagccggaaggccgctgtgagggagagggtggattttggtgaacttctttccttttaccgggaaaagccctatatgaaagatatcctgcggcggttccagctggatacggagcgcataaagaaaatggatctgtacgccgcggtcaactatatacgaaaaggaatgggctatgatgaattcctgagaaaacaggaagcggaagagggaaaggagaggggcacgcttctgaaggaagcggaatggatgcagcagcagatgaaaaaattctgctgtctggaggagcttaaagaccatatccttgcctgtgaaagagagctggagaaggcggaaaagaataaggaggatggggacggggtatatattctcaccatgcatgcctccaaagggctggaatttaataccgtttatattcccgactgcaatgaagggataatcccccataagaaaagcatgaagggagacgcggtggaagaggaaaggcgcatgctttatgttgccatgacccgggcgcgccgcaggcttacaatatcctatgtggccggaacaaaagaagaaccgggatttctctcccggttccttactgagcttggcagataaatgccggcctattcattttcaggctcaatcaattcatcaaactcacaactgtccagatattcatcgaatgcatcagcgaccatttcatactcatcgtcatcctcaatgaaacgcagttcaggttctgcattgggatcctcttccttttcagaataaccgtagaaccaaacttctccgtcgtcattctgaccgttttcattcagcggaagcagtacgatatagcttttctctgctacatcaagaattgtgatgaccgcacagtttacgagagtgccgtcttcgagctcaagctctacgctcatctcttcttcaggttcgcctgaaggcctattaaggttatcctcgctcatgaaaaatcctccattataaattatcagcagcatcttcattctaaccgatgtttgtcccggatgcaagggtatggataaaaaacatctccgccgtccctgccctgcctccatccgccctgccgcccctgatgtcctccctgtgcggccgccgccctgcaaggattcctgtaaggggtgttataagcacgccggtccttaggctgcgtcttttgcagccttagtaccgctgcgtgattatccaagcgaaagcgtcccctgtaaggaaccttgcagggcggcggccgcacagggaggacatcaggggcggcagggcggatggaggcagggcagggacggcggagatgttttttatccataccctggatgcaagataaactggtaagagaaggtaaggtgtggtataatgtacgcaatgagcaggtcggtatttccgtgttcagacggcggtctgccgcctgagtctgcagaatagaaacaggagataatccatatatgacaccgagacacaattttaaaattctccctgggacaccgtaccctatgggtgtatccctcacatctgatggtaaagtaaattttgccgccgcgcttcacaccaaagaagaatgcggtgtgcttttatatctgcatacggcaggtaagccgctgcatcttccttttacggataagaaccgtgtgggcaatatttactgcatgcagctggaagggcttgccgatgtacaattccagtataatttctatgccggagaggatattattacagatccctatgccggggtgatatacggaaatgaacgctggggcaggcaggcggagcccaggcttcgcggcggtatgtgcaggcattgctatgactgggagaatgacgctcctctgatgactcctttgtcggataccgttctgtacctgattcatcccagaggctttacatgccattcttcttccggtgtgcagcacagaggtacctatgcgggaattacggaaaagcttccgtatctgaaggagctggggattaccgcagtggagctgatgccctcctatgagttcctggagctggaaaagcaggagcgccgggaaagaagcatggatgaggccaggaatcactatatggatctgcctgaagagaaggacgagcctccccggattaattactggggttataaaagaggctattactttgctccgaagatgtcttattccgcttcggactgtccggcggaagaatttaaggacatggtaaagaatgcccatcaaaacggcatagaggtcatcatgcagttttattttcccgcggatgtgaagcgtgcctatatactggaagtgattaaatactgggtttttaccttccatgtggatggcttccacctactcggaatgcatatgccgacggctctgctcgctacggagcccatgcttgggaacaccaagcttttttatgaggatattccttgcggggaaatctatgataacaatgatatacccgtatataaaaacctggcggtatataacgatgattttatgtacgctgcccggcatttcctgaaaagcgacgagggttcccttcagcccatgcttgatttatggaagaaaaatcccaaacagacgggcgttatcaattatattacgaactattccggctttacgctggccgatctggtgtcttttgacagaaagcataatgaagccaacggcgaggaaaaccgtgacggggaaacctataatgtcagctggaactgcggagcggagggaaagacaagaaagaaatccattctggagctgcgtctgaagcagatgaaaaatgccatgctgcttctgcttacggcacagggaacgcctatgatagtcagcggcgatgaattcgggttcagccatgggggaaataacaatccctattgccaggataacgcggtgagctggctgaattggaagcttatggaaacgaaccgggagttcttctcctttgtgaaagaggcggtcgctttccggaaaaaacatcctgtactccaccgcccggatgaactgaccatgatggattatattgcctgcggttatccggatctgtccctgcacggagaggaagcctggaagctgaatgcggatggcctgagccgtcaggcgggtctcatgtactgcggctgttatgctaaagtggataaaaagaacaatgacaatttcatttatattgcatataatatgcattgggaagaacacgattttgctctgcccgcccttcctcccgacctgaaatgggccaaggtcctggatactgttccagacagacaggaagagggagagaacggaaggacagccgccgtagcagggcgttccatacagatttttgaaagcagagaaaaaacgggcaaagaaaaacagaaggcgggacagaaaaagaagtgacaacaggaaagaaggcatggaagcattttaagacaatcacttaccataaatatctggttatgaagggctgctttgcagtcggcctgtataaacagggacttacccatgacctgtcaaagtattctccaacggaattcctggtaggagccagatattttcagggagacagaagccctaacaatgcggagcgtgaagaaaaagggtattccagcgcctggcttcatcataaaggaagaaacaggcatcattatgaatactgggtcgattacagtataaaggaagtgccaggggggatagccccgattgaaatgccggttaagtatgtggcggaaatgctgatggatcgtattgccgcctccaaagtatataaagggaaaatatatacggatgcggatcctcttttatattttcagtcggccagggaaatccccattatgcatgaaaatacaaggaagcttcttctgcgtctgctgaccatgctggcggaacagggagaaaaaaagacgttcgcctatgtgaagggaacgcttttaaaaaagaaacagaaataaagttgaagaaaacagtggaaccaatacctctcctttaacatatagtactgtaaaggagatgagaatatgaactgtttatacttattattacttttatgctgctgcggccaatcaggtaattccggctgccagaacaacaattgcggatgcggcggaagacatcagcacggatgccagaataacaattcctgcggctgccagaacaataattccttcggcggccagggcaacagctgcggctgtgctgctccctgtgcggagagtacggtaagaccttcctgtccctgtgctgatgtaaggccggaacccattcccaggccggagcccagaccgaggacggaacccatgcccagaccttatcccaccttttccgatgggaatacctgcggctgtgaagaatagcaataaggcattttctccgaaatgccggaatatgtgaaggtaaagcccggcaggaccgtcctgccgggcttttgcagtgcgcccggcggcgcacgtttctaaccggtgcaagtccggaatccgcccggtagtgggaaggatatagccgaaagcaagggtgtccatcgcgaggtggaatctgaaggaagctggatgtggggaacatactaacccatgggcaaatctctggtctgacgaacagaaatcacatcaggctatgcatgggggtaagactgctgcacaagttgaagcccgataactacacggaaccatgcatggtaaatgtggcagatggatggagagaaagagacgtgtggtacccggggaggtctgtatgaaatgctccgaaaggagtaaccaccgcacaaggaaacgaggcggtgctgaacatgcagaagtcagcagaggtcatattagccgagaggtgaaggaccgaatcaataggagttttgagtataaccgagaaagaagagaatgaccaatgaatgcagaaaacatgataaataatggctgttcgcaaagagatagtgcggaacatgaagggtatgcgaaagcgcatcggtcatttcattcgatatggaaagaaagaaacagtgcacagccagaactcttggaaaagatactgtataaaggaaatttaaacagagcttataaaagggtaaaggcaaacaagggtgctccaggaatcgacggaaccacagtggaggaaataggtgcatacctaaaggaaaatcaacagactattattgcaagaatctataaagggaaatatacccccgacgcagtaagacgggttgaaattccaaaaccggacggtggaatgcgaaagcttggtattccaacagtcaaagaccgtatattccaacaagccataacacaagagcttatgcctatctatgagccgttgttttccgacaatagctatggttatcgtccaggtcggagcgcaaaagacgccataaaacggataaaggagtacgcagaacaaggatatatccatgcggttgctttagatatatccaagtacttcgatacgctgaaccatgaaaagttactgaatcttctgcgaaaagaagtaaaagacgaaagagtgatacagtggattaagagatatctgaaaagtggtgtcatggaaaatggagtagtcatggaaacagaagaaggttcgccacagggtgggaatatttctccattactggcgaatatctatctgaatgagtttgaccaggagtatgagaaacgtggtgtgaagttcgtccggtatgcggatgatatcgtcctgctggcaaagagcgacagaggcgctaagcgattacttgaaacaagcacgaaatatcttgaagggacactgaaattgaaagtgaatcaagagaaaagccgagaggtcagtgtatttgcaattcgaaattttaagtttcttggctttacattgggaaagaacagaaagggtatttatatccgagttcatggaaagtcatggaagaagatgaagtcaaagctgaaagaacttagttcccgaaggtctgttcagagcattcgcccctcattggaaaagataagagtcttcatgcgaggctggctgaattattatgggattgcagatatgaagaagcggatagatgatttaaactcatggctatatcacagaattcgtatgtgtatatggaagcagtggaagaaaccaaagaccaggaagagaaatctaatgaaacttggaatacccgaatattttgcacatcaggcggcaaacagccgaaagaaacactggtatgtatcgggaatgggtgcggtcaacagagcgttaacaaaagaaagactgataaacagcggcttctatgatttagccacagcctatcagtccgtgcacgtcaactattgaaagcgccgtgtaccgaacggtacgcacggtgctgtgagaggacggcggttagtcaccgcctcctactcgattttcagagcagagcctgcctcatatcttcaggcatgggagaggtaaagagcatgggctttcccgtgatgggatggtaaaattccagacggcaggaatgcagcgcctggcgatgtatgagggtcatatccggattgtataaaaaatcaccgattatcggatggcccagatactgcatgtgcacacggatttgatgagtgcggcctgtttccagatggagggaaagcagggagcagccatttgtttccttcaggacacgataatgagtaacggaaggctctccgttttgaaaatccaccatcctcatgatggcggagtcgggcttccttcccagaggtgcgtttaccgtgccggagggaggaagcccggttccgctcacgatggcaagatattccctctttatttcacgccgggaggccatgacggaaagaatactgctgcttaccatatgcttggcgatgattgtcagccccgtggtatctctgtcaagccggttgacgcatcggaatatgaaaggcacgccctgggatgaaaaataccatgccagaccgtttgccagggaattttcataattgttcatggaagggtggacaggcatatccgccgctttatcaagaatcataagatcctcatcctcataaacaatatgtagaggaagaggaacaggagggattttttcagacaccttttcttcccatatattcaccgtaaggatatctccctccctcaggtgatgaattacataggcaggcatattattaatcaggattccctgctcgtattttttcagctgtaccagattctgtccggagtaatgtttccttttcaggaattgttttacagtaaggccgtcttcccggatgccgattttatattggattgttcttttcatttttttcatttcccttattccgcaggtagcaaagcaaacgggcacgccgtctgtctgcctggtgactgccgcacattttataccgggcggcaggattcctttcgttatataatattccggatgattccgcaccctgaaaaaatccggaagtgtaacggtttggccccgttttgtcgtccgggttttgctcgctgccggaaagccttccggttacgctgtttctgcattttaatccgggtcgaaaggcataattgcataaaacacaaatttttcacattttaaacaaaaattagaaacattttcccgttagaatgcaaatatgcttaacgcgtaaataattaacaagtatataattagcatgttaacagatacgcttcgaggacggatgattgaggaggagacggatgaagaggaaggatgggccaaaaggactggacaggagaaagaaaattgctttaggggtgattcccataatggcactggcattgttgggcggtgttatttttttgacagtgcagaagggcggagcggatcagacgggacagatgggagggccgggaagggcagatggtttcggagaaaacgtgataacggccagcggaagtacctccgtgggaatgcaggaagaaacctttgatctggattacatagaaaccgaattgaaaatagaagaggtatatctgtcttcaggggatgaggtggaagaaggcactcccattctgaagcttacggatgaaagcgtggaggcggcccgcagggaattggagcagaagtctgttcaggcgtctctggattacagacagcagcttctggacagtgaagaagaaaagataaccgcaaagcagacctatgatacaagtatgacaaagggtacgtatgcttcctatacttatgaggaatccctgaaagagtacgcggataagatcagtgatttgcaggaacaggtggaagaagcgcaggagctggtaaatgaatatacggattccgtggaaaatgattattactattcctattatgaagtggctgaaaaaaaagaagagtttgaaaaaagctttgctgctctgatgcagctctatgaagattgggatattccaggtctggaggatcactacagaacaacggcgggcggcagttcctctgcctccggccagtcagattcctccgttcagtccggagcctccggccagcaggcagcgggcgggggccaggcaggaagcggggccggactcacctcggaaaacaattacacgaagcttacagtctacaacctgctggatgaagaagtacaggaaaatgaaaaaatatacgatcaggcggcagaagattatgaagcggcaaagaaaaaagcggaaagctcactggcccaggcacagagcaatcttaagctgctgaatacccagctggaagaagcacagattgcctatgataagcagcaggtaagcagtcagagtgattatgatgcggcagcagcagagagcagttctgcacaagaagtttatgaagcggaactcagcaggattgaggaagaaacaagcgtggcccttaatgagaaggaagaggcccgggagaatcttcaggaatttgaggatacgataggagacggctgcctgtatacccaaagtgccggaaccgtaatgatggtgggggtaagggcggaatctgcaatttcaggaaacagtatggtgctggcttacagcaatccggaaacagtgacggtaacagcgtcggtggaccagtcggatatcgcgtccgtttccataggagaaaatgtggcggtggaaatctccgattatggaaccttccggggaaccgtaagcaagatcaatccggtatctcagtccaacagcaaatccagtatttattattccgttaccatagagctggccggagatatcagcggactgtcccagaatctgtcggctgccgtatatttcggaattccggagtcggaagaggaggctgtaaatgaaacagaaacacaggaataaaaaatttgtcattaagctgattcttgcaggtacggcatttctcgcgctggccgccgtatgtgtctatacggttttcatacggccgaggctcaccggggacactgtaatatataaggaaagcaaggtacaatatggtgatttggttcagggtattaatgaaagcggaagcatagcccttcaggagagccatattaattatgaactggatatcaattattcagaagatgatgaggatgaggacgaggaggaagaggccagccgctatctgcagatagaagaggtttatgccgtacagggccagcgtatgcaggaaggggatccgctgtttaagctttcccgggacagtattgcggcggtccggcgcaagctgcagaaggcaaagtcagaggcacagctggagcttgctgaagcggtgagtgaatataatacccaggccggaagtgccaaaagtacctacagcgcttccaaagcggaagcggatacggcttcccgtacctatgacacctccatgaaccgcctgcagcaggagattgaactgctttacggggatattcaggtactggaggcggaaataaatgactataacgaaaagctgacggatgaggataccctggaggaatacagtgacttaaaatatgcctatgagacagcacaaaaaaagctggatgaaacggatatctccagtgtggcggcctatacggcaaattactccagtctccagagtgcgaagaccgcatttgagaatctggacaataccctgcagggctaccgtgacagcattgaagaaaaccaggaacagattctggagaagctggatgaaataaacaattcccagaccagccttccccaggacgaaatgtccgcgcagcagtcctatgacagcgccgtgctcggagggaagctggcaggtgatatttatggttatacacttgacgctcttcaggatactgtggatgaagcccggaccgctgtgaacgaagcacaggaactgctggaagattttgaagcctttgtgggaaccgacgggattgtctatgcggacggaaccgggcttgttacggaaattgcctatgaagcaggggataagctgatgaatacaggcgttatgctttcctatgtgacccgggatgcatataccataaccattgatgtatcggaagaagatatttcctatattaaggtgggggatagcgtggatattgaatgcaatgcctatcccgatgagatatatgaagggacggtgcgcgcaattactacatctgccgacagcagctattccacgacggtcaattatcctgttaccgtacggatagaaggcgataccggcaggctgtatggaggaatgaccgcggatattacctttgtgaccgacagtatagaggatgtactctacgtttccgcaaaagcgatagtgacgggagatgatggcagtacaggtgtctatataaaaaatacggaaggggaaatggaatggaaagcggtggaaaccggattttccaatggctctgaaatagagataacaagcgggctttccgagggagatacggtttatattgccagtacggtcagcgcaggacaaagtgaggaaagcctgaggcagtcaggagcctccctgacacaagaacctgccggggatatgacagaaggagaagaaaacggacagcagggattcccggatttcatgcaggtgcccggagaaaatcctcagggaaattccggccaggccggcggcaccggtttcggcggcccgggaatgccataaggagggagaacagacgtggataaaaagaaaaggatatggattggaacaggcgtctgcctggtgctggctgttggctgtggaatcggcttcctggctgcatatggaaacagcgatgaagttacctaccgggaagtgcaggcggagtatggagaactgaccgtgggtctggaagaaagcggcaatgtgacggtagggacaacggagcagacatttgatttggatctgagcgcctacacaggaggaagcacggacagcttttcctggggacagggcggaggcatttttcaggggatgggaggcaccggcagttccggttcttcctcctcttcttccagaaacctggtgatagaagaagttctgataagcgagggacaggaaatagcggagggagaaccaatttacagacttaccgaagagagtatcaatacgattcgggaggaactgagcagtgatgtttccgatgccgaggttacccttgaaaagacgaaaacacagaaacagatgacggatctgacagcaaaacaggactatgaaacaaatgtggcctatggaacgcttgcagatgcggaatatcagaatgcagtcaccaaactcacggatacggcggcggaaatcgaggaacagatagccgatatcaatgaagaactggcggaactgaatacgcagctggccgaaagtcaggcagaactggagacagaaaagaaggtcctggaaaacggggaatttgtggtgagcactacggatattgtttccgacgcctacggatggattactgcggagaatgcaagggaagaggctgccgctgtagtggaatccctggaggataccatagaagaaaccacggattccatcctcgaaaaacagaaggagctggcagagcttgaggacagcctgacaggagccgaacgggatttggaattgggaaaaattgatgcccgggctcagctggataagagaaacctgaaataccggacagcatcagaggcctataatgtgagtgtggaactgagtgatttcgaagccgatacggctcaggcagattacgatgatgccaggggcaagctggatgaatttgacgcttatctgactgataatgtcatcacagccggctacagcggcgttgtgacagaggtttccctggaggcaggggatacggtgaactcagggaatacgctgcttatactgaatgattatgatgaggttacggtaactgtttccgtggaggaatccgaccttgccaatatcagggaaggggattctgtgaatgtttccgtcgcctcttatccggacgatgatttcaccggtgttgtggaggatatcggagagtccacatataacagttccacaggaacaacctatgtggagatcagcgtgaagctgggaggggaaacctctaagctttatgaaggaatgacggcacagataacgtttataacgaaagaaacggaaacggtgacctatgtgtccaacagggcaataatcagggaaaatgggaagtcctatgtaaagaaaaaagaagcggacggcagtattagcaaacaagaggtaaccacaggcttctccgatggtgttaacgtggaaatcaaagaagggctttcagaaggcgacacggtcctgatagaaagtaaggtgagcgattcatgaaagtgacagagatactgcggcttgtctggctgaatttatcagccaacaaatcaaaggtcattcttacctcaacgggaattatcgtaggggcggccaccattatgctggtaatcgctatcggtacgggcggaaaagaggaggttgcggagcagtttaaaaatctgaatgccggggcgattgatatatcctatgaatatcagggaaacagcggcaggcccggaggcggatcaggaatgcccgggggaggcggcggaatgccgggaggtgcatttggaggaggcggaggcttcagcttcgcaggaggaatgttcatgatggatcagagccagaacaattcggaacggatcaccctttcggaatccgatatggaggatctggaaaccttcgtccccggaatcgcccgcacgaccatgagcttttccaccacctccgcagtggatggaggagagctggaaagcagtacctcttataccattgcgggtgtcctgagcaattatgccggaatcagcaatctggaaatggcattgggggattttctgacggatgagaataatacctataaggagaaagtctgtgttctgggctccaatgtggcgaagacagttttcggaagcgtatacgatgcctatgacggtacggtttatattgataaccggccctatcaggtcagcggaatcatcagtgaaatgggaaccgtagcctccggaatcagccctgatgatgccatatatatcccgtataataccggagtgaaatatttatccagcaccggtgtcagccccacaataacggttatcgcagaaaatgtgaatgaggtggaaaccataattgccaatatagagcaggttctggcggaaagctatcccaatgcggagtttaccatctctgacgcgggaagcaagatggaagccgcatccaaatccaacgatacgctcaccatgctgcttatctgcatggcggtaatcgtattcattgtaggcgggcttggcattatgaatgtcctgtttgtttccgtaaaggaaagaaccaatgaaatcggtattctaaaggcgatcggctgctgcaaaagggatatcctggcggaatttttaatggaggccagctgtatcagtctcgtgggtgccattctgggagttatgcttgcgctgggtatcacgccggccctggaatatttcggagtgagagtggagctttctgtatcaggagcggtactgtcccttatctttggtgtgctgaccggtacgatttttgggttctatccggcgtaccaggcatccagcctgattccggtcgcggcgcttaaccatgaataaaggagagaatccgatggaacagaatagtaagaaaaagaagaaaaaagggaagaaaaaaatagtgacaggcgtggtatgcttctgtcttcttacggcagcaggaggagtccttttctggcagaaacaggaggcggatgcttcggagagcgtgattgaaattactgcgggacagcaggaggagattatatatgctcagattgacagtattgtgggcaatgatctggagctttccctggcagaaaaagagacggtatctgccggaggggacgggaaaggaatgccggctccggaggaggaagaaccggcggaaagcagcgtccagattgatcagaccgggtttcccggtcaggcagggcagaacaatcagggtggaccgggaggctttgcgccggcagaacagggcggctttccgggcagtacccaagcagcaggcagcacaggacgccagagaggcggcatggattcttcggcctataccctcacgggagagacaaagagccttgaggtgccggtaggcacggaggtgattaccaagctgggagtggtgactaccttttcacggctgtcctccggaaatatcattgctgttttgctggaagaaggaaccgataatattctgaaaatttggattgtatcatagagacatgcgcaaatactccgtatatgtccggagatacatggcagggagccgatatggaaaacgacaacgaaatcatgattgtaatgaagaatatcaacaaaggctatatgctgggagaagaaaaggtcccggtgctgaaggatgtatgctttcaggtgaaaaagggagaattcgtggcaattcttgggccttccggttcagggaaaacaacactgatgaatatcatcggctgtatggatatcgcggattccggcgaatatttcctggacggcaatgcgattcatgaaatggaagagagcgaactcaatgacgtaagaaataaagagatcggttttatcttccagaattatcagctgatatccacctataatattcttcagaatattatcatgccgctggtggtgagaggcatgtcctccggtgaagcggaagaaaaatgtatggatactatccggcttctggggctggatcacagactccgccataagccctccgagctttcgggagggcagaagcagagggtttcgatcgcgagggcgctggtgggggagcctgccattctgctggcggatgaacctacgggagctttggacagagcgagcgggcaggaagtgctgaagctgttcggaaaactgaattccatggggcatacgattgtcatgatcacccatgatctgaatgtggcaaagtcggcaggacggatcgtacatatcatagacggagaactgagcgaggatgaaaattaattccccggctccggatatcgtttacttcaccgggattatcctttataattaggacaagaggaggacttggcctatgaataaaaagatatttctgacatgtctggcagcaggtattcttgtttttctgctgcccgcccgggaggtaaaagcagcggagaaccagacgacggaagattattattaccagctgcttataaatggtgagtatccttataatacggcggcgaatgccggaaccggcgtaactgtgccggcgggaggatgggagcagatggtggcgatggcaaaccagcagctgactcaggcagtggcccgccaacagtctcttgaggcagccagacagaacctggatgtacagcttcaggcggcgtcacaggcagtggttcaggcccaggcggcactgacagcggcccagcaggcttatgcgtctgcccttcaggcggcggcctacagccagcaggcggcgctcttgaatcagcaggcagcgctcagcaatcaggggacagcaggcgtaccgctgacagctccggctttaacagcggatacgattctgcaggtccagaatctgctcaatttttatggcagcagctgcagccctaccggggtatatgatgcccagacgcaggcggccctgtttcagttccagacaaaatacgggcttgcggcggacggaacgatcaacgcccaggttcttcagctgttcggattaggataatccttcccggacagaaaagagtaaaagtctaaaaaagcggaagcctccggatgaaaccgggagagcttccgctttatcgttctgtatgcaatatcagctggattttacttccttccataactcgttatagagggaatccgcatcatcacccaaataggtgaaggtttccagattattgtattcgtccaggttggggaacgcaattttggaattccggatatcttcgtcctctatcaagtcccttgcggcatcattgggagtggaataggtgatatactcaaaattcttcagggcgatttcaggacggcacataaaatcaatgaatttttccgcattttccatattaggcgcattttttgtgattacccaggaatcgatccagacattggttccttccttgggaacgacatattccagatccgggttttcacgctgggtataaatggcctctccggaataaattacgccgatagccgcttcatttccgatcattttatccctgacctgatcgatgacataggcctgtacaagaggcttctgtgcgatgagggaatccctggccgcattcaattcatcgggattggtggaattcatggagtatccgttcagttttaaggcaaccataaacgcgtcgcgtacggaatcctgcatcaggatattatcctgatatttttcattccagagaatggaccagctgtctacaggatcatcaaccatagtcttattgtacagaattccaacggttccccagcagtaaggtacggaatatttgttctccggatcgaactgctttgactgttcccagtactgttcgccgatattttttttcgcattgggaatgttgtcgtagttcagttctgccagcagatcattttcaatcattttctggatcatataatcggaagggcagacaacatcatatttggaagccccggcttcgattttgggatacatgatttcgtttgtctcaaattcatcataaataaccttgatgccggtttcctcttcgaacatggagatagtctccggatcgatgtattctccccaattataaacaaccacctctccgttagaagcggcggaggcggatccgcaggctgtaaggggaagaacagccagggacagcgcaagcagcagtgaaagacattttttcatttggtttcctcctcatagtagttggtgccggcctattctttatcctgtttgaccggagctttatttacgagtaaaagcagaatgagtacagtgacaaaaataattgtggaaagggcatacatttccggttttatcccttttttgacctcggtatatatcttggtggataaggtatcgataccggggcccttcgtaaagtgggtgatgataaaatcatccagggacatggtgaaggccatgaggaatccggagaggatgccgggcagcagatccgggaaaaccaccttgaagaaggctttgatccgggatgcgcccaaatccatggccgcttcgaaggtactgggattgagctgcttcatacggggcatgatgcttaaaatgacataaggaatattaaaggtgatatgggacagcaggatcgtgccgaacccaaaccgtactcccaggctgataaacagcagcatcagcgaaataccggttacaatttccgcattcagcatggggatattggtaattcccatcatgatggcccggttcctttttttcattccattgatggcgatacaggcgatagttcctattacagtggctatggccgatgataaaaaagcgatgagcagcgtgttgtaaagagcttccaggataatgctgttttggaaaagctcggagtaccatttcagagtgaagcctccccacttggccctggtacggctggcattgaaggataggaccatcaatgtgacgataggagcgtaaaggaagacaaaaataaggccgatatatattttctgcaaaagggtttgtcttgttttcataaggtctggccctccccttctttatcaaagacagaggtgataatcatattaaggataatgaatatcattaacacgatggaaagaccgctgcccaggtgccagttgcttgcctgtgtgaattcctgctcaatgacattgccgatgaggaggatcttgctgcctcccagcaggttgctgatgacgaaggttgtcagggcagggacaaaaaccatggtaatgccgctgattacgccgggaaggcttaaaggaaaggtgacgcgcagaaaggtctgcagaccgttggcgcctaaatcccttgccgcatttaccacgttcggatcaatttttaccaggacattataaatcggaagcaccatgaagggcagaaaattatataccatgcccagtacgatggctgccggggtattgataatattcagcgacggcagatgcagaaaggcgagaatggagttaatcactcccgttttttccagcaaggtctgccatgcaagggttctgagaagaaaattcatccacatgggaagaataaatatcagaacaataaagctgtgctggttcacattcatattggccagaatcatggcaagaggataggccagcagaaagcaaatcaatgtactgataagcgacagggcgatggaaagccataaagccttggaatgctccgcgctggcgattgccgcaacattggccagggtgaatgcgccggttttatccgtgagtccatagtaaaaaaccatgcacagcgggataatgataaaagcgacagaccagaatatgtagggccctgacagcaaatgcctgtattttttattattcatcaatggctgtggcctcctcatcctctgattccggcttgtgcataatctggatattgaacggatccaccttaatgcctaccggtgtgcctacaggatacatgccggtggagtgtaccagccattcgaaaccattggcggtaacctccatttcataatggacgcccttgaagatcaggtgggtaaccactccgcggataaggccgtcttccggggacacaagctccacatcctcaggacggataaccgcatcgacgggcttgttggttccaaagcccgtgtccacacaggggaaattggcatccagtatcttcaccagcttatcctggatcatcactgcatcaaaaatattgctgtcaccgataaaatctgccacgaaagcattttccggctcattgtaaatgtcttccggcgtaccgatctgctggatatatccctggttcatgacgacgatggtgtccgacatggtgagggcttcttcctgatcgtgggtcacatagataaaagtgattcccagctcgttcttcaggcggataagctcatactgcatatcctgccgcagcttcagatccagagcgcccagaggctcatccaggagaaggaccttgggttcattgacaatggctcttgcgatggcgacacgctgctgctgtccgccgctcagagaatccggcatgcgcttttcatagccgtccaggtttaccagcttcagggcatatttaattttatcgttgatataggacttgctttttccctttattttcaggccgaaggcgatattctccgcaatgtccatatgggtaaaaagggcatatttctgaaaaacagtattcagctgccgtttattcgggggaagattggtaatatccttcccgtcaaacagaacctgccccttatccggtgtttcaaagcctccgataatccgcagagtcgtggtttttccgcatccgctcgggcccagcagagtcaaaaactcattttcccggatatatagattcatatcgtccagaataagggaagaaccaaaagattttgaaatatgctgtaaatcaatcagcctgttgctcatatgcatgctccgtttctccgctctgcggtaggtgaatagtggaaggcaggcgaacctgtcttaaaaactgggcgggctgcttacccagatgagggaagcgccggttttttcgttagcggtgaggtaatgggtggaattcggggtaaaataaaaggattccccctttttggcgcgtatggcccgtttccctatgtggatggttacgcttccgctcaatatataaccgaattcctctccttcatgaggattgtccggataggtggaacctcccggttccagggtgagccggatgggctccataatgtttttctgggcattggggatgatccattccgttctgttcctgcaggcttcatccgtcttttcaaaataatcggaagaggagaagacgatttgttcctctgttttctcactgaaaaattcattgagatccgtgcccagcacctggaggatatctaccagggtggcgatggaaggagaggtgagatccctttccagctgggaaataaagcctttggaaagctctgccctgtcggcaagctcttcctgggtcagccccttctggactcggagctcctttaatttgtttcctatattcatatggtaaccggcctttcctgaaaagaacatataataaacttaaagtttactgacactaaacaagacgctgatacccattatactgaaatcctgttaaatgtcaatgctgtaaggataaattccgggtaaatttttgcggtgggtcccgtagaatgttcccgcggagccgtgtgccctgagagcgtgcccgccctgcgccccgttccctctgcaggagccgccgccttgcaaggttcctgtgcaggcacgctctcgctcggataaattcgcagcggtactaaggctgcaaaggacgcagcctaaggaccggcggatttatacggcctttacaggaatccttgcaaggcggccggctcctgcagagggaacggggcgcagggcgggcacactctcagggcacacggctccgcgggaacattctacggaactgggaaggttatgaatgaaaggagaggattttaggaattgaagaatagtataggctgacggatttatggatggaaggaggatggatgctgtgaagagaaggttccttgaaggggatgatattatgagtaaagggtaggaaaaaattgagtaaaaaagattaacaaacggggtggggtatgttaagattagtttaacctgaaaaaggatgtcgtttacaaggtaaatcacgacaggaggctgaaaaaatgggacaggataaatatgtggcgtatgtgtctgcatacacgaccggggatcggagtgaacaggggatcacggtgtatgatgtggatatgcagaagggaagatttacggagaaagagaagattaagataacgaattcttcttatgtgacgatctctcataataagaggtatctgtattctattacggattttggtgtggaatcttataggattaaggaggatggagggcttcaggttattaatatgggctccatcaatgggatgaggggctgttatgtgtctacggattatgaggataagtatatctttgtggcgggatatcatgacgggaagcttacggtgctgcgtattaatgatgacggcagcgtgggggaaataacggaagagatttattataaggggctgggaattgttgcggagaggaacttccggccgcatatcagctgcgcgaagatgaccagggataatcattatttatgtgtggcggatttgggaatggatcatacgaatgtgtatcgtctggatcatgtgagcgggaagctgaagcttgtggatgtgatccgcagtgatctggagagtgcgcccaggcatctgaagttcagtaaggatgggaaatttctctatattgtgcatgagctgaagaattgtattgatgtgtatacctataaggaagaaaaggataatcctttctttgaaaaaatacagtctgtcagtacgctgaataattatcatgcgggaggctccacggcaagtgcgctgaatctttctgatgatttccggtatctgtgcagctccaatgcgggagataacagcgcggctatttataagattgatgaaaaaacggggctgctgacgaagcttttgtgtctgccggtgagcggggagtatcctaaggatgtggcgcttttcccggataataagcacttggtttcgctgaatcaggattcgggaacgctcactttttttacgacggatttggaaaaggggctgctggttatgaatggcccggagatgaaggttgcgcagcctaactgcgtgattttccataaggtatccgggaaatgaagcaagcaggttgtttatagacaaaatatcagggaggactaaattttatggaaaaatggacgaggattgcacatcagccctgtctgcctatggggaaggacggccggctggtaacagcctgtgaggagcatatccggctgtcaaggcaggcggccacggagggtatggtgctgctgaaaaacgaatgcggtgtgctgccgcttaagaagggctgcagagtcgcccttttcggaaaagcacagatcgattatgtcagaggaggcggcggaagcggggaagttacgacctcctatacccggaatatttatgagggcatgaagatcaaggaagaagaggggaagcttcaggtttttgacgaactttcccgtttctatgaagaggatgtaaaggagcagtatgcgcagggaaaggaaaacggtaaaaccgtggagcctgcggtgcctgccgggctgcttcaggcagccagaagatatacggatattgcggttatcactatctgccgcttctccggggaagactgggacagaaaagggataccgggcgacggagacttttatctttcccctcaggaacaggaaatggtggatgccgttacggcggcgttccccaaagtggcggtagtgctggatgtaggcggaatggttgattcttcctggtttaaggagaatgagaagatccagagcgtactgctcgcatggcaggctggcattgaaggcgggctcgctatagcggatatcctgtgtgcggatgctaatccttccggaaagctggtggatacttttgcaggttcctttgatgattatccgtcctcggcaggatttaatgattcggatgattacgtggattatacggaagatatttatgtgggctaccggtactttgagacgattccgggagcagctgaaaaggtgaattatccttttggctacggactgtcctatacttcttttgcaataaggaattgctgcggaaggctggagaaggctgaggacggaacgcagatcgttgtggaagcaagtgttactaatgtgggggagcttgcgggcaaggaagtggtacagctgtactacagcgcccctcagggcaggctgggcaagccggcaagggcactgggcgcttttgcaaagacacgctgtctgcagccgggagaaacacagcaggttacactgcggctggcggcagattccatggcgagttatgacgataccggaaagatagcgaaatccgcttatgttatggaagcgggagaatacggcttctatctgggcaattctgtgagaaatacggaaaaggtatcttttgtatataaagaagaagcggacagagtggttcttgcgctgaaggagcgcgtggcaccccgtcagcttgccaagagaatgctggcggacggcagctttgaagagcttccggtgcaggcggaatgtaaggctgaaagatttcccggctttgtggaaggcaatcctcctcacaagggacactgggaaggagatgcggcagctaatgagcggggagcggatgcacctgagaagaaaatcatgctcatggatgtggtgaacggggatgcttccatggaagagttccttgcccagctgacaaacggacagctgatagatctgctgtgcgggcagccgaatacgggtgtggccaatacctttggtatgggaaaccttccggaatacggcgttcccaacctgatgacggcagacggaccggcgggtgtgaggatcaggcccggcctgggcgtatgtacaacggcatggccctgtgcgaccctgctggcatgtacctggaatccggatcttgtatatgaaataggtgcggcgggcgcgagggaaatgaaagagaataacctgggaatctggctcacccctgccatgaatatacacagaagccctctgtgcggaagaaactttgaatattattccgaagatccgctgatcgcaggaaagatggcggctgccaaggttaacggaattcagtctgagcatatcggggccagcattaagcattttgcctgcaataacaaggagacaaaccgcaaggccagtgattcccgggtatcggagagggcgctgcgtgaaatttatttgaagggctttgaaattgccgttaaggaagcccagccctggacgctgatgacctgctacaatatgattaacggcagatatgcttccgaaagagaagacctgttggcaggcattctccgggaggaatggggctttaagggcatggttaccacggactggtggaataaggcttaccagtacaaggaaatcaaggcaggaaatgatttgaagatgggctccggggatccggatgaagtactggaagcatggaaagagggtaaggtaacccggaaagaaatagaaacctgtgctgccagaattcttgaaaccataatgaaactggattaatgaaaagggtatgttgagaaaaagataattctaaacaggggagacagcgactcacacaagccactgcctcccttaaattttcaggcagaatccaaccgctgttggattcggtgagcttttcaataagatatgaagaaaaggtatagggagtatggaaagaaatataagtgcagatgatttttgccgctttatttggaaaagctatttagaggagcgtcggtacgatcttgtaaatgaatttgtctctgagaaaataagtattataggaaccggagcccatgaggtggagaggaatttagaagaatttattgccagttttacggaagagagcaatagctggaacggacgttttgtgatccgggatcagtggtatcaaacaacggagctttccgattcccattcccttgtgatgggggaattggttgtcagggaggataccgatgaaggtattttatatgatatgtgttttcggttcacagttgttctggagcagacagagagtgggtggaaaatagtacatattcatcagtcggttgccgatcccaaccaggcgagtgatgaatttttccccaatcatatggtggaaaagactcatacgcagattgtttataatctgaggcatgactctttaaccggattactgaaccgcttgtatttcaaggaaacctgtgaacgttttctggcagatggaactggcggggtgtttttgatgatagatatagactggttcaaaaagatcaatgatcagtatggtcatcctgcgggagacaggacattggtttccttttcagaaagcctgaaatctgtggtttctcccaaagatttaaccggccgtatcggaggagatgagtttactctgtttttagctgatattaacgaaaagagtgagatagaagattttcttgcaatgctgaaagcagactgggaggagaggcaaaaggcgttggagatgcatgataagatatctgtcagtgcgggaattacctttgcttcaggcggaaacgtttcttatgaagcacttttaaataaagcggatcaggctctttacctcgcaaaaaagaacagggataatgagcttgtgcattgggaacttttactccggtgaaataagaagaacctatgggaaattaagcggcaaaggcgctgcattccataggttctttttattttgtgtacagaactgaaaagttagtatttttatcagcggctgtgattatgagttacatcttataatggaactccatcaatcctgttctgacggacagccatagaacctgcgcagaccctccatgcgggagggcataccggcaaaaagcagatcgacgagagtgagagcggtcatcgcctctaccaccaccacagctctggggacgataaccggatcatgccgtcccttaatccggacaagaatattttccccgtttttatttaccgtttcctggggagagaaaacggagggggtcggtttgatatgggcgcgcactataatgggagaaccgtcactgataccgcccagaataccgcctgcatggtttgattttttggttatcctgccatcctctgtgagaaaaggatcattattctgcgtgcctgtggaagaggaaacagcacagccgtcaccgatttccaccgcctttaccgcgccgatggacatgagggctttggcaagagacgcgtcaagtttgtcaaaaaccggttcccccacgcctgcgggcataccgtcaaccctgcattcaaccacgccgccggcggaatcatgcgccgccatacattcctccagataagcctctgctctggcggagctttcttcgtcaggcatacaggtgggtgtagtgaggatggcttccctccggaaattctccatatttacggaaaccgggcctatgcttttggtataggcgcacaaggtaattcccagctccttcaatataatagaggcaacggctccggccgccacccgtcccacagtttccctgccggaggaacggcctccgccccggtagtcccggaaaccatatttagcgtcgaaggtataatcggcatgtcccggacgataataggatgcgatttcactgtaatcaccggaacgctgggaggtattcgggaccatcagacagatagcggtacctgtggttcttccttcaaagactccagaaagaatggtcacttcatccccctcctttctgggagtggaataccggctgccgccgggcttcctccggtcaaggaaggtctggatatctgcttcagaaagagaaaggccggccggacagccgtctatgactacaccaagggctttcccgtgggattctccccaggttgttattttaaaataggttccaaaagtatttcctgccataacaatattcctccggcagcggtatgctgcataataatctacagtcagatatgttcctgtaaaacatgggaaaagcagcacaggatacccgtgaactgctactaaattatagcgtatattccccgggcgggcaagatgatcttgaaggaaggagggcaatgtgttatcatgagttactgtttggaccatgcagttactgtatgcgcccgcagggtgtaaactgtgaatggcacctgttaggaaagacaatgcatttcaggcgaaaggcaggagaacggcggaggaaggacaggctatggaggaacagaagaaaatgggaaaaaagagaatggctaacgtggaacttctgcgtatttgttccatgctgatgatagttctgatgcatcttctcaatcacgggaaggtactggaaacagtggaaaaaggaagtgtttcctattatcttacctggacgatatttggtatatcctttgtttccatcagctgttatatcctgatcagcgggtattttttgtgtgaagcttcgttctcttttgtgcgtcttcttcgtctggaggggcaggtctggttttattctgcggctctttttatagcggcggcggtggtgctccggcagccattggatatgtcatccctgattgccgcggtattcccgatattatcctgtgaatattggtttgtgacaatgtatgcaggtatgcttatactgtcgccctttttgaataaacttctgctgggactgtcccgaaaacagttcaggctgctgctggggttcctctttgtgctgttctccctgtggcccaatgtgtttttcttttctccggcattgaattttggcggaggaagcggagtggtgtggtttgtgacagtatatctgttcggggcctatctgaaacgcttttatgtccccgacggaaggacggccaggcatttcctgcattttctggcggcaggccttctgataccggcaagcaggtttgtgattgaactgctgctggcgacacctttgggaaaaataggcttccttcaggatctgatgtggggctacagccttttttatcaatataattccgtccttgtgctggcagcggcgctgctgctttttatagctttcctgaatctggagataaggccgggaaggctgcagcgcctgattcttgcggcggcgccgttaagctttggtgtgtacctgctccatgacaaccctaattggagaggaatcttatgggaatggataaatccttcacagatggcggataaatggtatctggtaccgggggtgctgacgctggctgccgggattttcctggtatgcgcccttttggagatgctgcggaaaacagcggccgggctgccaggacggctgagaaggaataaggaaggcggcagaaaacagggctggctggaacggaaggctttgaaactggatgaaaagctgcttcgggaaaatgaaatgtaaccgagagaataaagataggagagaatatatatgtatcgtttgctgaaacaggaaggaagagcgaagagaggggaactggaaaccgtccacggaacggtgcagactccggtgtttatgaatgtagggacggttgccgccatcaagggagccgtttctacggaggatttggaacatatcaagacccaggtacagctgtccaatacctatcatcttcatgtaaggccgggagataaaatagtaaagcagctgggagggctgcataaatttatgtcctggaacaagcctattcttacggattccggcggatttcaggtgttttctctggctaccctccgcaagattaaagaggaaggtgtttatttcaactcccatatcgatggaagaaaaatattcatggggccggaggaaagcatgcagatccagtccaatctggcatccaccattgccatggccttcgatgaatgtgcccctgccaaagccgaacgggattatgtggaaaactcggtggcccgcactacccggtggctggagcgctgcaaaacggaaatgagccgtctgaacaatctggatgatacgattaataaaaaacagatgcttttcggtattaatcagggagccgtatatgcggatatccgtattgagcacgccaaaagaatccgggaactggatttggacggctatgccgtaggcggtctggcggtgggagaaactcatgaagagatgtaccatatcctggatgaaacggtaccgtatctgcccgcagaaaaacctacctatctgatgggtgtgggaactcctgccaatatcctggaaggtgtggaacggggcatagacttctttgactgtgtttacccttcccgaaacggacgccatggacatttatataccaaccatggaaagatcaatctttttaacgccaagtttgaactggacgagcgcccgatagaagaaggctgtgactgcccggcctgcagaagatactccagagcctatatacgtcacctgctcaaagccaaagaaatgctgggaatgcgtctctgcgtactccataacctatacttctacaataccatgatggaagaaatacgcgatgcccttgaccggggagaatttgcttcctacaaaaaagcaaaactcgaaggaatgagccagccggctgagtgatgctgtccggtgcatagcgggcaggccgccctgaggctgtttaattctaaaatttttttaaagtggggaaaagggcttgccccttgtccgttttttgtgtatgatgtttgttagaaatgtatgcggtattgccgcatatagttaaattgcagggctgttaagcccgacgtaggaggaagtaagtagagatgggaattttagcgagtgaagctgcaacagcaggaacaggaagtatgattggcgttatcttgatgtacgttgttattttcggtgtgttcttttattttgtaatgtaccgtcctcagaagaaggaacagaagaagatgaataccatgctttcttctcttgaaatcggagacagtatactgaccagcagcggattttatggagtcgttatcgatataaccgatgataccgttattgtggaattcggcaataataaaaactgccgtatccccatgcagaaatcagcaatttctcaggttgagaaagcgaatgccgacgactgatagacaggtgccggctgaaagaaatcaataatcctgcagacatggagcggtttggatatgcgcaggtttagggcggaaaatgacttgccggaagacagtcttttccgttttttcatttggaatcagcagtaaaaaatgtgcctggctatacattctggctatgaaagaatgcttttttattcccgcaggttattgcagctatatcgaaagggtatggctgttttttattgctgcaggttctttctgttgaaattctgcatattttgggctatgattataaaaagacggaaagcgcaggcgtaagggaagggcggtcatggccggcaaagaagtgttatttcctgttgtatgcgccgcagaagaagggattgtgagaatattatggaattacatatcggttgtataccgggcgacggaatcggcccggaaattgtgagagaagcgaaaaaggtattggacagggtggcggaaaagttcggtcataccatccaatatacggaaatccttctgggaggggcgtccattgacgtacatggtatccctcttacacaggaggccattgatgccgcgaagaaaagcgatgcggtgctgatgggatctatcggcggggacgccaatacctcgccctggtacaagctgccgcctcagaaacgtccggaagcaggacttcttgccataagaaaagagctggggctttttgctaatctgcggcctgcggtattatacgatgaactggcgggcgcgtgccctcttaaggaagaaatcagcaaagccggatttgacatgatgattatgagggagctgaccggcggcctgtatttcggagaaagaagaactaccgtggaaaacggtgtgcgtaccgcggtggatacccttacctataatgaaaaggaaatccgccgtattgcggttaaggcctttgatatagccatgaagcgcaggaaaaaggttaccagtgtggataaggccaatgtactggattcctccaggctttggagagacgtggtcaatgaagtggcgaaggattatccggaggttgaactttcccatatgctggttgataactgtgcaatgcagctggttaagaatccggcacagttcgatgtgatattgacggaaaatatgttcggtgatattctttccgatgaagccagcatggtgacgggttcaatcggtatgctggcaagcgccagcctgaatgataccagcttcggtctgtatgaacccagccatggaagcgcaccggatatcgccggcaaagacattgccaatcccattgcgacgattttgagcgcatccatgatgctgcgctacagctttgatctggcggcggaagcggatgcggtggataatgcggtaaagcaggtattgagggacggcttccgtacggtggatatcatgtcggaagactgtctgaaggcgggcggaagacaggtaggctgtcaggaaatgggcactctgctcgcagacagaatttaaaaatccctgaaaggagaaggatagattatgagaagtgattcagtaaaatcaggagtacagcaggcgccccacagaagcctgtttaatgcgctgggcattacggaagaggagagacagcgtccccttatcggtattgtcagctcttataatgaaatagttcccggtcatatgaatctggataaaatcgtggaagcggttaaaatgggcgttgccatggcaggagggacaccttttgtgttcccggctatcgctgtctgtgacggtatctccatgggacatatcggaatgaaatattccctggttaccagagatttgatttgcgacagtacggaatgtatggctatggcccacggttttgatgggctggtaatgattcccaactgcgataaaaatgttcccggccttttgatggcggccgcaagaatcaacatccccacaatctttgtttccggcggaccgatgatggcagggcatgtatgcggccataaaaccagcctttcctccatgtttgaggcagtgggaagcgttgcggcaggcagcatgtccatggatgagcttcaggaatatgaagaaaaggcctgtcctacctgcggctcctgctccggtatgtatacggctaattccatgaactgcctgacggaagcgctgggtatggggcttaagggaaatggtaccattcctgcggtatattccgaacgtatccgtctggccaagcatgccggcatgcagatcatgcagttggtggaaaaagatatcaagcccaaggatatcatgactgaaaaagcatttatgaacgccctgaccatggatatggctcttggctgttccacgaattccatgctgcatcttccggctatcgctcatgaggcgggagtggagctgaacatggaaattgccaacgagctttcttccagaacacctaacctgtgccatctggctccggcaggccccacttatatggaagatttgaatgaggcgggcggtgtctatgccgtaatgaatgaattgaataagaaaaatctgttatatacggatttgattacagtgaccggcaaaacggtcggagaaaatattgccggctgtgtcaataaaaatccggaggtaatccgcccgatagagaatccttattcccaaaccggcggcattgcagtgctgaagggtaacctggctccggaaacagcagtggtaaaacgctctgcagtagcccctgaaatgatggttcatgaaggacctgccagagtatttgactgtgaagatgatgccatcgacgctatcaaaaacggcaagattgtgccgggagatgttgtggtcatccgttatgaaggccctaagggaggtcctggtatgcgtgaaatgctcaatcctacctctgcaatagcaggaatgggaatgggatcaagcgtagcgcttattactgacggacgtttcagcggcgcttcccgcggagcgtctatcggccatgtatgcccggaagccgctgtgggcggaccgattgctctggtggaggaaggggatattatcagcatcaatatcccggaaaaccgtctggatgtgaaggtatccgaggaagagatggaaagcagacgtgcaaaatggcagcccaggcagcctcaggttacgaccggatatctggacagatatcggaagatggttaccagtgccaatcgcggagctattctggaaattaagtaatatattctgcgctgccctggggacagctgcggatcataaagagccaagggcggcatgaaacgggaaggcacattcctttttctgccgccggaggacagaaaaaaagaaacacagaccgcggaagcggcggaacggaggaatgcatgcagctgacaggagcagaaattattgtcgaatgtctgaaagaacagggtgtggatacggtattcggttatcccgggggaaccattctaaacgtctatgatgccctgtataaacaccagagagaaatctttcatgtgctgacctcccatgaacagggagcggcccacgcggctgacggctatgcaagagctacgggaaaggtgggagtctgtctggctaccagcggccccggtgccacaaatcttgttacagggattgccactgcctatatggactccatccccatggtggcgattacggcgaatgtaacccttcccatgctgggaaaggactcctttcaggaagtggatattgccggtgttaccatgccgattaccaaacatggctatattgtaaaggatgtcagcattcttgccgatactctgcggaaagccttccgtattgcggcatccggacgtccgggtccggtgcttgtggacgtcaccaaggatgttacggccgccttatatgaatatacacccaaagaaccggaaaaaccggaatgggtaaaaaaatataacgaagaagaagtggaacaggcgctgaaactgctcactaaggcaaaaaagccttatattttcgtgggcggcggagcggttttgtccggcgcttccggacaggtcagggaatttgcagccaaaatggatgcgcccgtatgcgatacccttatggggaaaggtgcttttgacgggcataatccgttatatacgggtatgataggcatgcacggtaccaagacatccaacctcggagtcagtgaatgtgatctcctgattgcactgggggcccgtttctccgaccgtgtggtgggaaatgtcaaaaaatttgcctccaacgcaaaaatactgcacatagatatcgatgcggcggaaattaataaaaatgtgcatgcggacgcttctcttgtaggcgatctgaaggatatcctgaatacgataaacagccgcctcccccagctttcccatgaggaatggacatcccatattaaagaatatatggaaaaatatccgttgaagtatgacgacagtgtactcagctgcccttacgtgatagaggagctggatcggataacgggaggagatgcgataatcactacggatgtgggacagcatcagatgtgggctgcccagtattaccattatacaaagccgcgtacctttatttcctcaggaggtctgggaaccatgggctatggcctgggagcctgtatcggagccaagatgggcaagccggataaaatctgtgtgaacatagcgggagacggatgctttcgcatgaacatgaacgagcttgctacagccagcagatacaatattcctgttatacaggtggtgattaataaccatgtactgggaatggtacggcaatggcagacccttttctatgatcacagatattctcagaccgtccttgcggataaggtggatttctgcaaggtggcggaaggcctgggctgtatggcgatccgggtgacaaagaaggaagaagtggctccggctattgaaaaggcgattgccgcgggaggaccggtgctcatcgaatgtgtgatccctgaggatgataaggtatttcccatggtttctccgggagccgctatcagtgaagtatttgacggtgatgatcttgccggagaaaatgcggcgcagtgatgaaggcgtgaagtatctgccttttatggaaggaatggccatgccgggcacagttttgctgcgcccggcatacttatacattatgtacgggtatcctcggaaggtctttggcagatagtaaaattcacggtcttttttgcggaaaaagcacataaattgtttaacgtagtagttgactaaagtaaaaggactatgtaaaatagacggtatcgggccgcagggaaagagtagcggcctgtgaaataaatatgaggaggagaattagtcgtggcaagagtatacaatttttcggctggacctgcagttctgcctgaggaagtattgaaagaagctgcagaggaaatgatggattacagaggatgcggcatgtctgttatggagatgagccaccgttccaaaacctatcagacaatcattgatgaagcagaagcggatttaagggagctgatcggtattcccgataattacaaggtgctttttctgcagggcggggcgagccagcagtttgcaatgattcccatgaaccttatgaagaacaaggtggcagattacattgttaccggccagtgggcgaagaaagcatggcaggaagcatccaaatacggaaaagcgaacaaaatcgcctcttctgaagataaaaccttctcatacataccggactgttccgatctccctgtttctgaggatgcggattatgtctatatttgtgaaaacaatactatttacggaacgaaattcaaaacattacccaacaccaagggcaaaacgctggtagcggacgtttcctcctgtttcctgtccgagccggtggatattaccaaatacggtgttatgtacggcggcgtacagaaaaacatcggacccgcaggtgttgttattgtcataatcagggaagatctgatcactgaggatgtacttcccgggacgcctaccatgcttcagtataagactcatgtggatgcgggatctctgtataatacccctcccgcttatggaatctatatctgcggcaaggtattcaagtggcttaagaaaatgggcggcctgacggctatcaaagaactgaacgagaaaaaagcggcgattctctatgatttcctggatgaaagcaagctgtttaaggggaccgtgcgtaaggaagaccgttctcttatgaatgttcctttcatcaccggcagcgaggagttggatgccaaattcgtgaaggaagcgaaggcagccggtctggagagcctgaagggccacagaagcgtgggtggtatgcgtgccagcatttataatgcgatgcctgttgccggagtggaaaagctggtggaattcatgaaaaaattcgaagcggaaaatgcctgattcgtatatatggtttgttaaaagaataatttaggaaaaaaggagaagtcccctatgtttaaatatcattgcctcaatccaattgcgaaggtgggactggatggttttaccgaagaatatgtaaaaacagaagatatcggggaagcggacggcattcttgtaagaagcgctgccatgcatgatatggatctcccggataatcttctggcggtggccagggccggagcaggcgtcaataatatcccgctggataaatgtgcatccaagggtattgttgttttcaatacgcccggagcgaatgccaatggcgtgaaggaaatcgtgatcgcagcgatgctgctggcttcccgtgatattgtaggcggtatcaattgggtggaagccaataaggataacccgaatattgccaaagacgcggaaaaagtgaaaaagaattttgcagggacggaagtccaggataagaagctgggtattatcggacttggtgcaataggcgttaaggttgccaatgtggcaaagcatatgggtatggaagtatatggctacgacccctatgtttccgtagatgctgcctggaatctaagccgcgatgtaaagcatgttatcaatgtggatgagatttatgaaaattgtgatgttatcaccatccatgtgccccttttggactccacaagagaaatgatcaatgaagcagctattgcgaaaatgaaagagggtgtgatccttctgaattttgcaagggatcttctggttgatgaagaagcggtcctggccggaatcgaacagggaaaagtacgtaaatatgtgaccgatttccccaaccttacaacggcaggcaagccgggctgtatcgtgatccctcatctgggagcatccaccgaggaatccgaagataactgtgcggtaatggcggttaaggaactgaagaatttcctggaaaacggaaatatcaataacagtgtgaattatccttcctgtgatatgggaatctgtgatcaggcggggagaattgcaatattccatctgaatgtggcgaatatgataacgaaattcaccgcgcttttcggtgataacggcatcaatatttccgatatgaccaataagtccaaaggagacgtggcatataccatgatggatgtggagacgcctcccagcgaggagattatcaatacccttcgttctatcccgggtgttatccgcgtgcgcgttgtaaaataagattaatttttgttcacggcaaaatgtccggagcggttttaataccgtttcggacattttttattgcagaagcatattttatgaaatcacctttcaagttttttatataataaccaatgaactgtttcagtcccattcagacggcctgataagatgtccgggaatgcgggtattcaggttccctttcgctgcgttaatctgtccctgcgtcaagaatatgctttcacttaaatcagcattttggatattagtatcccgcatatctgctccaaggaaattacatccggtcaaatcacattcctctaaatttgcagctatcaagagtgctgaactgaaatcgcagccgtttagccgggattttttgaaattatgccccataaaatcctttttccctgcgatatctttcggattgccaacctgctgttttaccattatccaggctttgttcagcaatgcatttacttttgtcctgcaaacctccatgtcgaaatccaaaatattttgaggagtggatttcaaaagaagatgtaactcttttatacagctgtcagcttcggcccagagcgactttgcgggcaataaggttaaaacctctgacatataccacaatatttgctgcagatagtatgttttcacaaatacatcaaatacctcctgtgctatagggggatttgatttccagttttcatcgccgtacagtgaagtgactgtctgtcctgctccgcagcaatcgtaagctaaacatcctttcatatgtctggagtgcagctccttgtgtatggagcagcggaaacaatcatctaaatagctgcatggtatcccggctgctttgtcggcaggaaagccgtcatatttggaaaagtataaggctgtacagcaaagtccgctgcatttattgcatttaatcctgaattcatcgaagatatttgtattgtactgatgaagcttcaacttgcacctcttccctgcagacacaatgatacctctcacttgtgccgctttttctgttaatagtataattgatgtaaaatatatcgtcaatcgtttgaagccaagtactccatccgggtatcagatgtgatacaaaatttcttaattactaaccgcccttatataccccttgtatcggaaataagaatcagttatacttatttataaataacttgataacggaggtaagagaatggctgaaatcagaccgttccgggcatacaggccgaaaaagggcctggagcagcgaattgcagcgttgccttatgatgtatataacagggaggaagcaaaggctgaagtgaagaaggaaccactttcctttctggctgttgacagagcggagacccagtttgacgacagcgtagatgtttatgcggactgcgtatatgaaaaggcccgcgaaatgctgtggaaaaggatagaagaaggcagctttgaacaggaggaaaccccggtttattacatatatgagctggtgatggacggacgggcgcagacaggaattacagcctgtgcgagtgtggacgattatctgaaccaggtgataaagaagcatgagaataccagggcggataaggaagccgaccggattcgccacgtggatatctgtgatgcacagacaggcccgatttttcttgcataccgttcccagcctgtcattaacgccattgttgcacaatataaggcgggggagccactgtatgactttatttcaccggacgggattgcccacagggtatggaagatagacggaccggaggacgttgatgcagtacacagggctttctctgaggtgggagagatttatattgcggacggccatcatcgctgtgcctcagcggtgaaggtatctgaaaaacgcagacaggagaggccgggttataccggcgaggaagaatttaatttctttttatccgtgctgttcccggacgatcaattgatgatcatggattataacagagtggtaaaagatctgaatgatttaacaaaggaggaatttattggaaaaatccgggaatccttccagatagaggaattgcagaccggtgcggatggcaggccggataagaagggcacctttggaatgtatctggatggaagctggtaccgcctgacagcaaaagagaatattttatcaaaggatccggtaaagggccttgatgtgtctgttctgcaggattatctgctggaaccggtgttgggaataaaggatcctaaaacggataaacggattgattttgtgggaggtatccggggaatgaaggaactggaacgcagggtttcggaggactgcaggatagcatttgccatgtatcccacttccataggggaactttttgctgttgcggatgccggacttttgatgccgcctaaatccacatggtttgaacccaaattaagaagcgggctctttattcacagtctgcggtagaagagcttagaaagttgaggaaaacggtatgaaagataaattatataaactgatggattggcgtgagatcgaagctatagtctattcggaggaggataacccgcacaggctgctcgggcctcatacggcaggaagctctacactgcttcagacctttcagccgggggcggaacaggttacggtggtgattcctgagaccggaaaggaagtggcaatggagctggcggacgaggccggatattttgccgcgctgattccgggaaagaagatcggggactataccttaaaggtagattatccggacgggcgccatgaggaaattatcgatccataccggttcgggccggttattaccaaaaaagatacggctctttttgctgcgggaacccattatgaggcctataaaatactgggagcccatatatgcagtgtggaaggggtaaaaggcgtgcattttgccgtttgggccccgaatgcggtcagggtgagtgttgccggagattttaacaactgggacggcagggtgcatcagatgcgcagactctgggattccggaatatttgaaatttttatcccgggagatttggaagggcagaattataaatatgaattaaaggcaaggggcggccttacttatctgaaagcggatccgtatgcttttgggcagcagttgcgtcctgacacggcgtccgtcatccgcgatatttcgggatttttctgggaggatgaagactggattgcccgcagggagaaaacggattatacgaaggaaccggtaagcgtttatgagctttatctgggatccttctgcaagccggagaccggaagaacctactgcaattacagagagcttgctccgaaaatcattgaatacgtaaaagagatggggtatacccacatagaactgatgcctgtcatggaacatccctttgacggttcctgggggtatcaggtaatcggctattacgcgcccactgcccggtatggtacgccggaggactttatgtttttcatgaatgaaatgcataaagcgggaatcggtgtaatcctcgactgggtaccggctcattttcccagggacacgtatggattatccgcttttgacgggacatgcctttatgaacaccaggatccccgccagggagcacatcctcactgggggactctgatctataattacggaaggcctcaggtatgcaattacctgatagccaacgcgctgttctggattgaacagtaccatgcggacggcatccgtatggatgcggtggcgtctatgctttatctggattacggcaagaatgacggagaatgggtggctaatatctatggcggaaatcagaatctggaagccatggaattcctgaagcatgtgaacagtatgattcataagcgcggaaaaggagcattgtccatagcggaggaatccaccgcatggccgaaggtgaccggcagtctggatgatgacggcctgggctttgacatgaagtggaatatgggctggatgaatgatttcttaagctatatcaaacaggatccttattttcgttccggatgccacaatgagcttaccttcagcatggtttatgcttacagcgagcactttatgcttgtgctgtctcatgatgaggtagtgcatggaaaggcttccatgctcggaaagatgcccggaaccagggaagaacagtttgaaaatctgaaggccagttatggcttcatgatgtgccatcccgggaaaaaactgttattcatgggacaggatatcggagaatatgatgaatggaatgaggatcgcggcatagaatgggagcttctcaatgagccggatcataaagggctcaatgaatttgtaaaggaattgaattccctgtacaggaatcagccggcactgtatcggaaagataccagctgggacggttttgaatgggtgaactgcatcaatgcgaatgactgcatcctttcctttgtaagaaaagcggataagccggaacagatgctccttgtggtgatgaattttgccaatgtggaaaggaaaaattaccaggtaggcgtgccgcttaacggtaaatataaagagattctgaattcagatgccaaagtcttcgacggcgaaggcagagtaaattccagaatgaagcctgctcttgaggagccctttgacggaaaggattattccattaaaatgactcaggcgcctctcagtatcagcattttctcctatcagccctataccaaagaggaactgaaggaaattgccaggaagaaggcggaaaaagagaaaaaagcgaaagaagcggcaagaaagaaacaaggggcaaaaaaggcagcgcccaaaaccctgaaggaagaactggcagataaggtttttgaggccgatgcggccatttcggagaagggagaggtggaaaagcccgtcagagtgataaaaacccgtaaaaaggcggagaaagaatgaacagatttatcgtattgacagcagatgtggcagaagaactggcgctggggcagaagcttttaaaagcggcgccccagaccatgctcgatttgcttatccgagtggttatttgtgttgtagtgtttctggtaggatcccggattatcaatttggtgcgcaagctgacatccaatgcgctgaaaagggcgaatgccagtaaggaagccaagcagttcctggattccacactgaaagtggggctgtatgcctttctgattttccagatagcggtcaagctggggattgatgccaccacaattgccacggtgttgggttctgctacagtgactatcggactcgcctttcagggcagtcttaagaattgtataggcggcattctgatcatgcttctgcatcccttccgtgtcggagattatattattgaagataaccacaaaaatgaaggaacggtttcggaaataaccattttctataccaagcttgcgactattgacaacaaaataattctccttcccaatggttctttggcggatataagcattacgaatgtaaccaatgaggacaacagaagagtggaactgaaggtgggcatttcttaccgggccgatatccgtaaggcgaaggcggttattaattctcttattgaagcaaatgacaggattataaaagacaaggaataccggatattcgtggatgatttgggagccagctccgtagtgatcggcatgcgtttctggacaaagacagaagattactggccggtgcggtgggatatgctggaagagattaagtatgcttttgatgagaatggtatcggaattccttatccccagatggatgtacatttggatagagggaatggggaagggtagttgtatgtgaagcgtatatgaggaaagcaggtatggtaaaaccaattagggaagaggaactttttgaaagtttggaaatttttcaccggggatatgaaactgttgctgcagaatttggtttgacggaggaaaattgtccggatagagggagggccagtctgccttatcataaacttctaagtgaatttgaaagcggcatattgatgtatggctattttgacggggataagctgactggttttttaggtatgaagattttggaagacagcagcaaattagaagatctcataatattgccggaatacagaaaattgggatatggctcctgtctgctggattattgcaagaaaaagaccctggaacttggattgaggaaagtggtgcttggaatgatagatgacaatgtccggcttagaaattggtatattaaaaatggttttgtcaataccggttataaaaagtatgagaatgcaccttttacggtaggttatatggagtggaatagtcaaaaaaattaatgattaccgataccgggatatttttgtatacgggtgtcttttttgattattaaatagtatgttttattgttaaaataaatttggtaaaaaattttaagataaaaaggaaaaatactcttgtcaaaaagtgaattagcctttataatgaatagcgtcggtaaattgctggaatagcgcagttggtagcgcaactgattcgtaatcagtaggtcgagggttcgagtcccttttccagctttggcaagatatctatttattgaaaaatttgacagatatatagttaaatagctatcaaacaggtaatcgcacatacacatttggatgtatgtgcgattttgtgaaaataggttaatttaatcctataattacagaaaaaatttttttaactacaagataaacagaggaaaataatcagtttgaataaatccgtactgtaaatgctatatatgagcaaatggcggcaattatgatgacagatgatttttaaaaagaagagtgatcttttgattgcttttctttttttattgggacaattgtcttttcgtttaaaaataaactctttttattgaatgattataaatagcatgatatgatttatttatctgaggtatatgaaggtaatgaggtagaaatatggcgaagagtatatatttggagaaggcaatgctgtcagatgaacttacgcttgctgttgaagtaagcgggtataaacaacaatgggatgaaatcatccggtatctagcagaaacttatgttgatttttcgcaggaatggaaatattatggtaaagcatggggatggactttaatgctcaaaagcaaatcaaaaaccttatgttatataacccctgcgcaggaatatttccaggtatctgttattttcaacgataaaggccgcgctttggcggctgcatatgacctgcctgaaaccgtgcttcaggcagtggaagcttccaagagtaacccgaaaaatattccgtacgatttcgatatcaggacaaacactgacacggatattgcgaaaaggcttattgaaatacgttctaaaacgtaatctgcttttgttgcagaagactgtttacaaatattaggacagcttgatcattgagggattagaatgaaatttatagtaattaaaattatgcagggtatgatggctgaagcacagaagccatgtaaaactgacgagcggaattgttcctatatcatggtaaacaaatatatacgtgctttttgtattttggcagttattatttctgtttttatattttgctttatgccgcaatatataaatgaatccgttgtaattgctatagtactgctcgtaatttcactaattattttattcattactttgaggacattatttaagagatatacattaacagattccgggctttcgtgttccgtgtctgccggaaaagtaataagctatggcgagttaaacaaagcatacatagagtgcagacagaatgaatttgatgatgtactgcatatcgatggaaagaaggcgatctcgttacacttgttttacggcagttatgattttatcaggcagctcgaagaaaaagcggatataacgctggaacgaaaagatacgaagtttgccgaaaaacccaaaatccttccattggcggccattctcatcttaggtgtgattttatttgtaatgaaaaatgcctcataggctttaatagatgagatgctatccgaactcagcaagagatgtaaagataaaagtgtttcattcacttataattacagatgagaggagggattgtatggattggcttaaggggatgaacagtgtaacacagtatattgagaataatttgactcaccctattcagtatgaatcgctgtccaggattgttggctgctctgtgtatgaattttcccgtatattttcattcatggcaggaatgtctgtttcggagtatattcgccgcagaagattatcacaagctgttttcgacattcaaataggtaatgataaaattattgacattgctttgaaatactgctatgaatcacctactgcatttgcgagagcgttcaaagaattacacggcacaacacccttatccgcccggaagatgggcgttcctttaaaaacctatccgccaattaccttcgtactcactatcaaaggagtgaacgaaatgaattttagaattgaaaagaaagacagcttcaaaattatggggttgtcaggatacgagaatggggaatgcaaaaccggtgatagtttgacaacactttggcgggaatttatggataattacaattttcgtttgtggaacagcggtgggacggacaattattacacggcacctttctggcaggttgcagcctatgattttcagtccgatggaggacagacaaaggttatcattggagccgagtataagggtaaaaggccggacggtatgacggtacaaacagttcctgctgcgacatgggctgtgtttacaatttcgtcacccaccggaattgattatgtgccggcggcatacacacgtattgtaaccgaatggttaccgtcaagccagtatgagcgtgatgaatcggtaccaagccttgaggtatttcccgggggtgatgcaaattcaccggagtatcaatgggagatttggatgcctgtcaaaaacaagtaaactcatgtgtttttgttgagcaaatgagaataagacgtttctaacaaataccgatacagtgattaatagctgtatcggtatttgttatttaatgtatgagtatcgttaattcggtataattagtcctttatgggtacttttggaaaatgaaaaatgcagaagatcattattcttcctcagaaacaatattctccaaaacattgattaaatcataaatatcattaatctgtacattacgctctaatatatagtcttttaaattgattgataatgtttcgaatttttcccgaacctcgggtgctacataggatgccatactttcatcacctctttttgttagtatttacagatgagaaaaaagtatgtgaaacagtttaaaaaaatttaattaatcatagaagactgcagggtgtgaatcgcttttttggcccacagagaatcctttaataaagctctgccgacgccaatcaaatcggcagaattattttccaacagctcttcagcggcagcagcacttgtaatgcctcctgttaatatgacaggaatggagacgtgcttttttatctccctggtgatttcactgaaatagccctgttcctgcgaagtcggattcgtatatccacagaaaccgcctgatatatcaagtaatgaaactccggcttcttcaaatgcttttgaggctttgacactgtcctgtatggagctgcctccgtctgcataatcacaggcgcccagacggaccgcaatcgggaaatctgtaccggctgtttcgcggacagcatttatgatctccaggtgcaatttcatgcgtccttccaaagtggatcctgtataggaatccattcttttattggttaatggagaataaaattgattcaataaatatccgtgtgcagaatgaatctccactccgtcaaaacccgccagttttgccctcctggcagattgtgcgaaatcctgtatcacattttgtatgtctgagtctgccatttccttgggcagggcaggattatttggtctggcatttggcaattgtatgctgctggcgcttaatttttcgcagctcgtattgccgccgacagcaacaccgcctgcatgattgatctgtgcaaatgcttttgaaccattttggtgaatgacagaaacaagcttctttaatccatcaatatcttcatcacatgcaatagaaagctggttagggcttgctttccctgtcaggctgacatagctgtgttccgtaatgattaatcctatgtatccgccctgcgatttttctttataataatcgcataattctgttgtgaccgtgccattctcgccggattttgctgttgccataggcggcatgactaagcggttgcttaatactgtatttttgattttcagcggttgtgtcaataaactcataaaattggacctccttaaatgattgtcagttcttatctggtctttttcattctaccataatatgatcgaaatagtaagaaaacacgataaagtgatatactattaaaataaggcaaaacgtttatcccggtttcatcccggtttcctgcagaatattgtcatccttttgcagatatgctatattggtacagacaactgaataataatgtcttcagggcagggtgaaatccccgatcggcggtaaagtccgcgagcgtgaaacgcaggatttggtgaaagtccaaaaccgacagtatagtctggattgaagaaggtgtgttgaatgtcaggataagtctgactatttttacactctttttccgtaagctttactatggccggcctgctctgatggcatttatcaatacacctgaaaattaacgcctgaaagatattattattctttcagacgttaattttttcaggaggtattgataatgtacagtaaaaccaagaaaacagcagcagttgggatgctctgcgcctttgcatacatagcgacggctgtggggcgtgtccctgtcgtactttttttgaagtatgatcccaaagacgttattatagcgataacaggtttcctttttggacctcccgcttcattttcggcggccttgattgtctcttttgctgaaatgctgacaatcagcgagaatggggtgttaggccttattatgaatgttatttccagctgttcctttgcgtgtacggcggccttcatttataagagacgccgggggcctttaagggcattcaccggccttttatgcggctggggactgatggtggtggcaatgatgttctggaattatttagtcgctccgatttatatgggctatccgagagaggctgtggtcaaattgctgcttcctgcattcctgccgtttaatctgctcaaaggaggcctgaatacagcaataacaatgttggtttacaggcctgttattacagcgctgcatcgttgtcatctgattgaggcggacgaaaattcatgagaataattgtgatgaacatggaggatggagatgaggaactgttactggaattaatggactcggtttccgtacatgagggaaagattgaggtcatatcatctgctgcggttccttccgtatcgtttaagggactgacaataaattgcgggaaaaggcaggtattccgcgaggataaggaaatcaggctgacacgtcttgagtatgatgtgctttatctgcttgcggcacacgcaggccaaattgtatcaaaagaactgatttttaaggctgtttggggcagcgccagcgaagatacgattaaggtagtggctaatactgtttctaatctgagaggtaaaatggaaccaaaccgacactgtccgatatatattaaaactgtcttcggtgggtatctgttttgtgatgaaatgattacggacaccccatgataaaagaaaagatagcctgatcaggataaaatgagttatacttataagcgatgaatagaataatagccagcggagaatgagcggaaagcgggtgtatttatgaagtactatattgtggatgcctttacggatgagcttttccggggaaacccggcgggtgtctgtttactcgaaagagagcttccggatcgggtattgcagaaaattgcatatgaaaacaatctggcagagaccgcttttttgttaaagaaagaagatacatattccctgcggtggtttactcccgaggttgaaatggatttatgcggacatgcgacattggcgaccgcttttgttgttatgaattttgtggatccggaattgacaaagatagaatttgagacgcagagcgggaaattgtcggtggagagagcggaagatttatataaaatgaattttcccagcaggatgcctttggaaacagcagcaaatcctttgctggaagatgctcttggctgtaaagtcctgggaacctatctttcaagagatcttctggtgctggctgaaagcgaaaaagcagttgaaaatcttcgggtggatatggataagcttgctgctataagcaaagatatttcttttgctgtgattgttactgcgaaaggatcaagctgtgattttgtgtcgcgtttttttgcaccgaatgcaggcatctgtgaagatccggttaccggttcggcgcactgtacattaatacccttttggagccgcagacttggaaaaaacagtatgactgcaaagcagttatctcccagagggggagtgctgctatgtgaagataagggagaacgggtaaatataagcggaaaagcggtttgttatctggaaggcgacattatgcttcctgatttaaaagattagagtacatacttttaattcctgcggaatgcccgcataaataaaaaaacatggctattatgaaatcttaattgtataatatgatattggatgaaacgaattctgtcataaggtttggcatgaagcaggaatattacataatacgggggcgggaagatgggagattttatgatagcggcgttgccatggataataataggaattgctgttgcggttatattagccttcaggagccataagaaggacgatgaaccccaaaactgcatgacggaaggaatgtgtatcggaatgtgcctgggtgtggcgataggtagtacaggtcttatcagtctggcattaggaataagctccggaatgctgattggtgaagtgattggatttattattaaaaaatagcatatggtacaaaatacttgaggaggagatgtatatgcataaagagtatatgcttagctgttttaacctaaataagatggaagatgaagaggatttttttgagtctattgatgagatgaaatcttatattgaacagggcggggagaatataattgtggaaggtacctatcatcttgatgaaataagtattgattagccgcagtatagtatatatttcctgttctgatcattaactttaaaattactaaatgattcagaaaaatagaacatatgttcttgaaatatccggatgtttatgctaatataaaacaaacaaatgtttgcaaattatgccagatactttgtaatgaattaacgaacagacttatataaatatataggtatgtaagaaatatacactaattaaaggagtcagcaaatttaatggacaatattatgaatccccctgtagagcttgagtggggccccgcagaaatagttcttgcatacaatgacagtaagaataccaaaagggtagccaaaactttttgcattactgataaggaagttaaagatattttgaaaaaggccaaggttaaaatccttccggtaaaagaaaaaacagtttctgatgcggaacaggcgttaaatgaaattggcatgagtcagaaagatttttataaaagctagagtggaagaaacaaataaaactatactatgattccctaaacaaagaggctgtcagagaatataataagctgttttcttccggcggagaaaacatataggcccgacaggaaaaggtacaggcatgaaaatggtgtgtgtcaatgagaataaccgggaaatggtaacatcttttataaaggagcactggtttactactgaaatggtaatacgaggggatattatagatatgacccgggcagagggtatcattaccctggacgagaaggaaaatatttcagggcttataacatatatgataaaggattccgtatgtgaaataacctcgctcgacagcctgcaggaaaacaggggaacagggactgcactgattcaggagatgattcggttggcagaggacaaaggatgtgaaaaaattgttctggttaccactaacgacaatatcaatgcccttcgtttttatcagaaaagaggcttcgatatggttcgtatttatcgcaatgccctggataaatcacggagcctgaagcctgaaattccgttggtcggggagaatgatattcctttaaaacatgaaattgaatttgaactgttgctgaaccaagaaaaggaataaaagataaattgttaatttacaggtggaaacgacaaaacagtaaagagattcttcaaataataagccgggagaataccaaaatcaggtctttctcccggccaacattatctaaaattttgatttttcataattatacgtgatacttgtccctacgacaacatcttcaatcttgtcgataatgagccagtcgtccatatttccctggtgatcaaagggcagaggggcaatttcctcaacatcctcaaattcaacaaggcacagacattttttatgccagcgttctttctgcttttcggtcaaattcaatttctcctgattgtcttccagtacccggcagatttcttcttccgtcagcttaacataattctgaacatccctgacttttgccttagcagtaatcattaagcttcctttttccataaaataaagctcttctcctttaaaaacacggctatgaggtatttttctgccggcagcgccccggattatcattgtctttgtgccggacagtattttgtccagaactttttctcctttttttcctgtattatcacaatatactaaatgtaccatttcatttctcctctataatgggtatccatatctgacttaagtagttttcatcgtaattgtttccttcactgtaccattccagttccggacagtccgcatgacggaaggggtatttcaggagccattcttccgtcaggtacttccagccgtcctgaatggcctgcggtacggcgcctctgcagtcgaaaacagcccaggtggtatccggtatcagaatttcattataaccgtcatctgcctgctgtgtggattctacggcaatcatataatcggatgtctcagaagcttcatctaagtatccaaacaaaccgtaaagccctttggggtttccgttatccatggcgagtaattcggcaatggttccgtccttctggcatttgctccagaattccgggactttggaatattgctgtccattactgcagtttatttttgtgcgtctgcccaccagccggaaaggggctccggatataagcctccaggaatattgacggtttacggcagccttcattttggggaataccttcagttgggcctcctcattgcgggattgggcaggtgatatgccatggaactgcttgaatgctttggtaaaggatgttggcgattcataaccgtatttatagctgatatcaaccactttgctttgggtactttttaaatcgtaaccggccagggttaattttcggaaacggatataatcagcaaagctgattccattcatataagaaaagactttttgaaagaaggaataagaacagccggcaagccgcgatatttcatccggattgacaggttcttccgtgcgctgcaggtgattttcgacataatcaatgattgcctgcagcttatcagtccattccatgtttaatctcctttcatagatagtgtttctattttaccattaaaaatgcaatcaggcatctcattttacgtaccggcaggatagaatctctcttttggaaaattgcagtttgagtcgaaaaaacgcatagatggggtgaaacccggtaagaatgcgggtaggagaaggaagaagagaaaaatagaaatacttgacaaggcttccaaagtgtgcttaatattataagaaaaaaacctgcaggcagttatcaaccgtgaaacgcgcaaaacagcataaaaactgggataaaaatttggccggagataagattagttccggcgccaatatttgtgtggaaggggctgatttcatgtagaatcagctcttttttctataattatgaggaaaagaaggagaagtggaatgaaggcgtacaaagacagaagcaaggaagaactgctcactctcaaaaatgaactggaagcggaatacaagaaatttcaggaaatgggtttaaagctggatatgtccagaggaaagccgtccgcagaacagcttgatatttctatgggaatgatggatgtcttaaacagctctaccgatttaaaatgccgtgaaggaattgactgcagaaattacggtgttattgatggtattcaggaagcgaaggaattactggcagatctgattgaggttcctgcggataaaatcattatttatggaaattccagtctgaacgtaatgtatgacacagtagcccgttccatgactcatggcgttatggggagcacaccctggtgcaagctggacaaggtgaaatttttatgtccggttcccggttatgacagacattttgctattacggaatatttcgggattgaaatggtgaatgtgcctatgactccggaaggccctgatatggatatggttgaaaagctggtgagtgaggatgctgcgattaagggaatctggtgcgtgcctaaatattccaatcctcagggaatcacatattccgacgaaaccgtacgccgttttgccaatctgaagcctgccgcagaggatttccgtatttactgggataatgcttacaatgtacaccatctctatgaagacgatcaggataatatccttgaaatcctttccgagtgtgagaaggcaggaaatcctgatatggtttataaattcagctccacttccaagatcagcttccctggttccggtgtggcggcaatttccgcttcttataataacctgaaggatatcaagaagcagatgtccattcagacaatcggccatgataagctgaatcagctgcgccatgtgagatatttcaagaatctggacggaatcaaggtccacatgatgaagcatgcagctatcatgcgtcctaaatttgaagcagtgcttgatatccttgaagaagagctcggcggtctggaaatcggttcctggctgaagcctaagggagggtatttcatttccttcgatgcactggaaggctgtgcaaaggcgattgtagcaaaggctaaggaagcaggcgttgttatgacaggcgcaggagcaacctacccttatggcaaggatcctcaggacagcaatatccgtattgctccttccttccctccgatggaagaattaattcaggctaccaggctgtttgttctttgtgtgaagctggtcagcgttgataagcttttggaaagtaaataacagattaaaaacaccgggcggcaatggtatgcgtccggtgttttttgattttatgctgcatttacccgcatttattctttagcccttaaaacctgggcaggagtcagttcctttagtttaaccagcaggagtgtacggattaaaaaatagcacagcagaattccaatgtaaacgacagaatagagaatgggtgaccaggagagatcccctccgcaggcaatattaaaaataaaagcagggtaaatgaggtctatgagtattttgccggcaggcagcatcagcagtgagccaaaagcgatgagataagcactgccgtccagataaagctttctgatctctttgttccggtagccgaatattttcatgagagaaatgttgtaggaggaacgatctatcataacctttgtcatttgataaaggacaatcaggaaaacgaatatggaaacacagatcagcataatcatcagaggtttcatgatttccataaagatatcagagcttttttctatatctgcttttgtagagacggcatataatcgtccgggtgcaatatccagggggctgtcggaatatactgcgttatagtagccgtcatcctgattaaaaagagcacgcatactgtcaatatccatgaaacagcacaggcctgtggaatatggtacaatttccgttatggtaaagccatagagcctttcattgacttcgtctttcagtatgaattcgtcacctgcagacagcctgtatttggcggcaacggaagaagagatgcagatttcattcttccggtttggggagaagtcagggaaaaagggattgtcgtccgtgaggccaataatactgacttccatgggaaagccaaagacatcctttttcagcccctttatgtaagcgggataacctccttcgggaacggcttctgcaggatatttatattgatacatataggaaaaacgggtatcggccgtattctgctgttttatgttaaggcagagtgaataacagttcagtcccagcattaaaatcagcagagaaacaaacataccggccaatatggcaagacagctgcgtttttcacgcagaaactgccggatttgaaatgtacttaaaaaggagagatggcggatccggattccgttttctttttcatcggatatttctttgcgcagcagggacagagcgcttcttttcagccgtttctgtatgagaatgcgggttaccagaaaagcggtaaaaggcggaagcaggaggccgtagatcagcagccagcggctgaggcaggtttctataggcggagtagagtagtaggtataggactccgctgtcatcatggacattcccagctgagaataacccagagcggtaccggctgctcctcctaaaaggcaaaggagaaccggaagcatggtataatgccaaagcagctgtttccttttcaggcccagagcatacagggcgcctataacagggctttcctgatcaatggagtgtatgataaatacggaaataacataggtaatcagtatgagtacgatgattccggctgtaaggccgactttgatattgatttccacatcccggttcgctgctttgatgcgggggttatcctctgcttttacgaagtccgtgagattttccatttccagagggtagatgctgtccataagattcccggctttcgcctgaagttcttttgccccctgttggaacgcttccgggttccctgaaagggctccggcattctgaagcaattcctgtaagctgtcagtcagcgtatctctgtcctttgttttctggcttaccatttcctgaaaaaagggatcttttacttcatcgggattgatttggatattcttaaggtaatccttcagttcggaatgcgtcatgttatccccgagaagataactgtaacggtattcttccgcgtgaagagcttttccgccggcaagcagttcattataagcttcaggggtgacgaatgcggtgccgaaaacattgccgtccgaagacatgccggacatgttctgcagacagtattcataatcggggctggtaccgataccggaaatggtatagtcggtaccggcaatctttatgttatcgcctatggaaagttcatgggcggcagcataaatccgttccactataatttctcccgggaaataagcaggagcaccctcttccagattcaccagattaagagattcccggtttttcataacacggagagttgaggcatcctccatgagaaaatcaaggtaaaaacattcttccaaagttacccgcatatgtttcaattcctgcagagtctttttatcaagaggtacaaacacaccgaattgtccgtcttccagatgattggcttcggctcttttattgactgattcaatgacacttactgcggatccaatggttcccaccacaatgaaaatgcagaggatgatgagcagaaacagtgccatatagcggaaaaaatttgttttcaaatcacgcagggtacgtttaaataataatttctgcattttttgttcctcctaccatgtgagtccggaagctgggatccgggagtcattttcatattccccggaaatttgtccgtctcttatttgtattactttatgagccatgctgcgtatagcggcgttgtgagtgaccatcagaatggtagtgccatatatttggtttattttttccagcagtatcaggatttcctttgctgttttggagtccagtgcacccgttggttcatcgcagagcagcagcttcgggttctttatcagagcacgggctatggcgcagcgctgctgctggcctccggaaagctgggacgggaatttattcctgtgttccgtgagtcccagtatatccaggagttccgacatggacagcggtaccttagacagatagccgcatacctgaatgttttcctctgcggtgagattgggtatcagattataaaattggaatacaaaccccagggtatcccggcggtaatcggacagcctttccggcttcaggccggtgatttctttcccatcgatatgaatttgcccgctgtctacggtatcgagaccgcctatggcattcagaagagtggatttgccggaaccggaaggaccgagaattacacatatctgtcccctgtctatcagggtgctgatcccgtccaggactttgcagtagctcccgccttccccatagctttttgttacattacttatttctacatacataatactatctccttataataaaaataacgctgttatgtaaatgttatttaaaaaagaccattaaggtctttttatttaagattattggtatccgggaggagagacagaaatcctcctctcataaagtgtatcataattttaagctgctccgttgcctgtggcttatccagattatgggacagaatatggaggacagcatctatctgaagatgggaaaaccaatggatggtacaatcattaaaataagaattttcagggaggggcggcttagcctgtgacagaagctgtaccgtctgataatcgagcatttgtatgagagtatcgaagaaagaacataccagaggatgctctctgttatttaaaataatactgcatatagccggattatcaaaaaacagctcaaaaacttcttctgcggcacggaaatcttctgattcatcctttgcgatgctgaaagaagagctggccagttctctttcataatgttctttcataagggacagaaggcgatccgtgacaggggaaatcacatgaccgaacaaatcctctttatcctgaaaaaagaaatacaaagcgccggtagttacatctgcccgggaacaaatccggcgcagagaggctttttcaaatccaaattcactgaattcaagaactgcggactgcagcagtcttgttttggtttcttccggcacagaacctgcgtgtctgctcatttctcctcctgtctttccgtgttgggatacaaagactttcctgataaaagtattttaaataacaatgttattttaaactgtatggtctgctttgtcaacagtattgtttattttaggaaaaaagaagtataatgaaaacatgtcactgcagtccgaacagagttaacggctgttaaaaatatatattggccgggtacttggactatactggaaggtatggtaagatatacagggcaaaatgacgatgcatgaaagataacaggagtaaagtttgaaacaaagtacgtttcaaatattgaattaatatccgctgaagcggataaggggtataaaaatggaaaaaagaaaaaatgaaacgatagaattgcttatgaaacgcaaatccatgcgggtatttgaagataagccggtgccgcaggatgtaaaaaggcagcttttggaagcgtccctgcgtgccgcgacggctggaaatatgacattatacacgataatcgacgtgacggaccaggcattgaaggataagctggcagtcacctgtgataaccagccctttattgcagcggctccccttgtcctgatttactgtgcggattacaggagatggtatgaggcattctgccgggtggagacggaagtgcgcagaccttcttacggtgattttatgctggcggcggaggatgccgttatcgcggcgcagacggctgttacggcggcggatgctctgggacttggcacctgctatataggtgatatactggaaaattacgaaacccacaggcagctgctggggctgccggactatgtggtgccgattgccatgatcgtggggggatatccttcacggcagcaggaggagcgcaggcagacccctcgttttgcggtggaagatatcgtccatgaaaacggttatgatatggaaaaagcaggacgtatgatggaaatgatagaagaaaaagaagactggcatggggagaacctgactctgcggctaaaggccttctgtaagagaaagtggaactgcagcttcagcgaagaaatgtcccgctcggtaaaagccatgctggacgcatgggccggaccggagagcggaaaaaccggcggcagggaataagcggacagggaaggaaaggacaaaaatggcatctggaaactgtgagaactgtgtgaattataaatatgaagaggattacgactgctacatatgcgatatggatctggatgaggacgagatggtgcgttttttaagtgcatcctttgaaaattgcccttatttccaattggaggatgaataccgcattgtgcgaaagcaaatgtagcggaagcggaggagttatggaagagacagaaaaggaatcctcgttggataaagccgcagcggaagatgcgcagcgcagcctggttctggagtgcgctatgcaggcgggaaatattcttcttcagaacggtgcggaaatattccgtgtggaggagacgataacccggatgtgccgccattatggggtggaatccgaaagcgcctttatattgagcaacggtatttttattacggccggaaatgaaaaagaatctgtatatgcgcaggtgcgtcatattcctgtacggggagcccagttggacagggtagcggcagtgaaccagctttccagggaaattgtggaaggccgttatacaatagaagaagtaagggaacaattaaaacgtatagaaaccatgccccgcaaaaccaaaagaatgcaggtgctggcatcggcggtgggaagcgcctgtttctgtgtgatgttcggaggaagcttcagggactgtctgggggcctttatcgcaggttttcttctgtatatttacgtgctggagctgagccagcccagaatgtcgaagatcatcggaaatatcggaggaggggcgctggttaccctgctgtgcattttcatgtaccggatccatatcggggatgcgctgaaccacatgatcatcggcgctataatacctctagtccccggaattgcattcacaaatggaatccgggatattgccgacggagattatattgccggtgctgtcaggatgctggacgccattctggtattcatgtgtattgcggtgggggtaggtgtggtaatcacggtttaccatcgtctgacgggaggaatgctgctatgattgtgacacaggttcttgccgccgcattgggaacggtggcttttgccctccttttcggcgtgccccgcaaatattatctttactgtggatttatcggaggggcaggctggctgctttactgtcttcttgaaccggtcctgaatgcgacggaggccaccttttttgcttctgtactggtgatattcctgtcgcggatgggggcagtaagggaaaaatgtccggttaccatattcctgatatcaggaattatcccgcttgttccgggagcgggaatctactggtcggctttttatatggttaccgatcagctggcggaggccggagaggccggtttcgctgctgtgaaagctgcgatagccattgtacttggaatcgtctgtgtgtttgaactccctcagggggtctttcggttcgtaaaaaaggatcagccgtcccggatacgcagaaagagcaggaaaaaggaataatatccttcttctgcccttcctgcagtgatgcgtaaaaaaactgcatttctttttcctattcagtttgtatccggactgaccggaaagattcagatctgggcttcccgatccgaatattctgccctcagcttgcggtttcttttatgcgttttgaccagggtgaaaaatttgttgtagaaccagaaagagtataccaacacggtattgacctttccgattttatccttggttgtcctgcggtaaagagtgccgccgcagccgattacttcctgtgctttgatacaattgatcaggtccgtttcggtctgtaccgtatcggggacctcagtgtaggctaatcccacacagtccattttatgggaatcacttccgccgacgccgggtttatggtacttctcggcaagacggcaggccgtagcattggattcttcatcctcgcaggcattgaaaacctctacaaaatcaaattgttccacgattttaggatcccggcggtaagttctggtattgcggaaacttaaatatttttccccgcagggatgtgccgggcccaggattcctccataggagtggacaatggaaatcaggatattaagaggcaggccgcgcagctcaagaatacggagctttatggtttcaggcacgatcacaagaatgtggccggcgccaagggtatcgtactcaatgcccttgaaaaccttgaagtctgtatattttttatccttcaggttttttttccagtagcggtagccgttgtaggtatcatggtcagtgataaccatccctccgaagcctcttgactgcagcagctgtatatattcctccatggagactctgctgtcgatagagccttcttttacatggcaatgcatgtcgattttcataacaggcatacctcctttaacattattattgtagcctttttccccggatttgaaaagggtaaaagacaatattttattgaaatatatcattccattttggacatgttaatgatagaatatgtaagaatagcaggaacattcaatctttacagaaaggtaacaaaaaacagatgataaattttatcgccggtgaagccggaatcaagacttcagcatttattggaattttatttgcctttgcggcaacctgccttgtgatgtggaaaggaatgggaatgctgcccagagatcagggaagagaatttgcagtagacgggaaaaagtctgccggtaaaccgagaggagccggatttttgtttgtcctggtatttattgcggcggcactgcttttcgggcaggtcaaccgtgaaatgattatatatctgattctcacaggcgcagccatgattaccggttttctggatgattgtgccaaaacgccctggggggaatataaaaagggttttctggatttgctgattgcagtgatggtggcggtcactttcctgaattttaattccaatgaagttacaatactccttaccggagcttcttttgccatacccccaattgtattcggaattcttgtagtggttctggtgtgggtatccattaatgtaaccaactgttccgatggtgtggacgggctgtccggaacgctgacgattataacgctgatgattatttatcttgtggatctgctgcagagcaggggagacagcttttcttatctgattttactgttctgtgtctgtatactgggatacctgtggtataacgccactcccagcagactgatgatgggcgatgccggttcccgggccatggggctgtttatcagtattgccgtattgaagaccggaagtcctttcctgtatattccggtggctttggtgctgattctggacggcgggcttgggctggtgaagattttccttctccgttttctgaaaataagaatccttaccagggtgaggacgcctcttcatgatcaggcgagaaaagtatgggcgtggtccaatactcagaccgtattccggtttgccatcatacagattatgctgggggcagctgttatttttattgcgatgtgattccttttgaccgaaacggagaatgtccattgccggattcggaggcgaaccggggttgcgctggcggaggaagaatgatagaatagcagataagcatttcggaccggatggcttccacccggagggaatgcggctgatacagcgcataatctgcacagggaaaggataaacatatgaagaacgaattactttccatcggaccgtttaccatttacggctatggactgatgatagggattggtattattgcagcatatcttacagcggagagcagagctaagaagctgaagctggatccggataagattttcgggctggttatctggtgtctgattttcggatatctgggttccaagatcttgttctgtattaccgttattgataagatcattgccgatccggcatacatccttcattctcttcagaatggatgggtcgtatacggaggcttgatcggcggcatcataggcggatgtctgtactgcaggcataaaaaagtgaatttcatgccctactttgatttggcggtgccttctgtggctcttgcccagggctttggccgcatcggctgtttcctggcaggctgctgctacggacaggaaaccagcagccctttgggaataacctttacatattccgactttgcccccaacggagtgtcgctgatacctactcaggaaatttccagtcttttgaacttcctgaacttttttatactgataaatatagctaaaaagaaaaaagcggaaggccaggtcggcggcttttatttgattttttatagcatcggccggtttatcctggaattttaccgaggggacttggaaagaggaaatgtgggaagcctgtcaacctctcagtttatagcaatctttacattaatagccggtatccttctcgtggtggttccgcagatgttagctaataggggagtaaagatttttatggtaggcccggacgggactgccctgcaggatgaaaaaaacggcagtgaagagaaaaacggaacagagattgcttctgaaaaaacggaattaacagaagaagcagaagtaccggaagatacggcggaaattacagagccggaggataatgacagcggtgaaaagactgcggatgatgaggaaaagggcgggacagcttgaaagctgctgcccttttcctttcatgaataaaaaataatatggggaaggaaatgaagaatgaaaattttagatatgcattgtgacacgatttcagagctgctggatataagaagaaaaggcgatgcagcccggatagaagagaatacgcttcgttccaacaggttacatattgatttggagaaaatgaaaaaagcagattacctgctgcagaattttgctttgtttgtccacctgagcagctgtgagaatcctctggaggaggttctggagctggccgatgtgtactatgacgaactggataaaaacaaagatctcatccgcccggtatactcctatactgatattgagagcaacaggaaggccggcctcatgtctgccatgctgacggtggaagagggcggtgtatgtaagggaaatccggccttcctgcgcaccttatacaggcttggagtgcggatgctcaccctcacctggaattttcccaatgaattaggctggcccaatctggaagtgccgggagaaggtgtggatcacgaatccttccggccggatttccggaaagccaatgtaaatcagggccttacggaaacaggtatcgcctttgtgcaggagatggagcgtctgggaatgattgtggatgtttcccatttatcagatgcaggcttcatggatgtgctgcgggtgacaaagaagccctttgtggcgagtcattccaacgccagggctgtctgctcctgggcacggaatctgacggatgatatgattcggctgctggcggagcggggaggagtaaccggattgaatttctgtccggctttcctgacagatgtgccggatggagaagccacctatggttcgatttctgctattgtggagcatgcaaagcatatcgtcaatgtgggaggaacagactgcctggggctgggaaccgattttgacggtatcaagacacatgatgagctgcctgatgcctcctatatgcctttgttgattgatgcttttggaaaagtgggctttacctcatcccaggtggataaaatcctttcggggaatgtgctgcgggtttataaagaagtgttagaataaattaagaaaaatgccctttgaagattgttatgccaatctattattgtttaaaacaataatagattggtcagtctataagattcttaatatttttagcatattttggcttatatgtatatgctgatgtaatcttccatttggaatttctcttttcaagctgacacattacagcaaaaacattctgtggtttttctagtgctataaatccttcaataagaatagaattactgcctgtaattgccgaaatttgtgtctcatttataaagtaatatctgatgccaataacaagttcaccatttttatttattttagaataattttttttgttacttaacttcataggttttataacttcatttttattagtacgaatgacaaaacattttgtataaaaatcgggatattctttttttgtagcattatttataaatgcaaattcgatatctagtgagccatagccgaaattattattattgagttcattaaaggtcatgtcttcaaaatccgaataaatcctgcctgaactaaatacataaatattgcaagacttaagcagcaatacatttggtcttggatttatagtgggttttgaagtagcttcgagtgaaaataatgtaatttgaggatctagcatagtatttctccttaatctgtgttcccgaggatgcagtataaagcgttcatggcttcattagaaagctcagcaggccctccttgggttgaacttgatttgcgaagttgggtgataaattcatcccatccgggcagagttgaactgttattactgattgttatgggttttatactacttgaaaaatacttttcattgccatcaattggcggatattgatattggaagtagtgcatataacgtttgctgcttattttgtcatcattatccatttctttccaatcctcaatctcaaaggtatcatcattcaagtcgcagtaatatcccttttttactttaagaatatccagaccggtaaaagtccattgtgtatcaatataaaactgtcttccatgagtcccttttccataagtgaatccatatacaaatataactgtatcaccagctgtaatatcaagaatgtttttcatgaccgaaggagtactgctgtagcgaaatgcccatacacccttattccggcctcgaagagtataatcattgtaactgtcgcctccgtttcgcccagcagaaggaagaaaaataagccagtttttgtttgctcttgtttcatattcgttcaggtagttgcctatagtaccatcaattatatgttttgcatttttcagaaaccaataagaaaaatctacagcatctaatacagatatattatctgtttcaataaaggaatcaggtctacaatcattgtttataactatgaggaagcctttggtatctttataagccatatcatagacctcttttccatggttgaatcgtgtaacccgccactcgacttcaatattcagacaggtattatccttaaatataatgtgaaaatctgttaagtgtttactttgaccattattatatgaaagaggatattccggaataattacctttacttttttctgagaccattcttcaaatttagcaggaaatagagagtgatattttttcttactcccataagttaatatttcgtatatatatctttgcaaagttttttcacttataagtttttggctttccatgcatcttcccggcatttttttctccttatactttcaaaatattttaagaatcagataataagaattatatcaccgaaaacaggtattgtcacttttgcaataaacaattattatagtacatataaagtattgatgattgcactaaactgacggaaaaacaggagaagaagcagtgaaaatcgttattgaggagcctggggatcaggaagaggatcaggttatattcagatgccgtgagatgacaccggagcttctccgtgcacttgcattgctgaaagcgcaggatggtcttgtagcatacagcggaaatcaaattcaccgtatcggaactcatgatgcttactatatagaagtggttgaaaataaaacctttctttactgcagggatgcggtatatgaattaaagcaaaagctttatgaattggaagaatgcttaaccagcagcgatttgctgagagtatccaaatctgtaatgctgaatttgagcaaaattaaatcactcaatcctgctttaaacggtagattcgaagccgtacttgataatggagagcgtgttatcatctcaagacaatatgtaggcagcttaaaaaagcgtctgggaatttaggaggaagcgaaagtgccgataaaagatttgctgaaaacaatgtttcactctttttttgtaattaccacaggcgtaaccatggctatgtatatatcctgccggctgttatatccggataccgtcctttctgtcggggatataggggggattctgctgctggcgctgttttgtgatctgtcttttttaatatttgcgtcagggaaagagcttgggaaaaaacagatggcggtacgcttctgtatccatatccctttggaggtcgcgattgttttattttttgcttctaaatgggactgggttaatatcgataagccgttggaggttgctgtttttgtactgttgattttaggcgtatatgcggcagtacttgctgtagcttattatcaggataagaaaacggcagacaagttaaatgacagcttgagaaagagataccattcgtaatcgttttgtaagggcggcagcttgccgtcctttttttgcaggttaccgtcctgtttccgcatcctgcctgccgacatattgagaatgaaagccggctgagatatactgtggggtaagctaaaggattaaaattcaggccaaggccgggaaatgcggagagaagaatgatgcagaaagaaaagaaacgaagaaagattttacgtacaggactttgcgtaatcctggcattgctgctccttacagcagtgggtgcaggggttctttttcaggaggaattgggaattatcggtactatccgtaaggaatctgatgaatttcccttatattatatggaggtaaaaggggattatcattttgaggagtttctggagagcggaggcgcggcttcggataaagaggtggaagcttttctgacaaagtgtatttcgaaagggttttaccagatagaaattgaagaagtcggcccggcatgcagtatgatatcagcagaagatgaaaatggaggccatgtctggggaagaaattttgactggaatggatcggtcccgattattgtcaaatgtattccggaggatggttatgcatcaattgcaacttgtgattttaagaacattacgggcagcatggagaccaggccggacagctttatcaataaaatgctggcaattgcagctctctatgttcctatggacggtgttaacgaagccggtctgtgtgttgcagatctggaagttaatgagggcggcatggaaacgattgatacagataaaactgatttgacaattacaaatgcaacaaggatgattttgaataaggcggccacagtggaggaggccattgaacttcttgagcaatacgacatttatgcatccggcggtatcagccaccatcttgctgtttctgatgcttccggtaaatcggttgtattggaatttgtggatggcaggatgctgcctgtggagtctccctgcgtcaccaattttaatcttgcgggaaaagacagttcctcaggaggggaaagctcacaaagacgttatgaaagtctctgttccgcctatgatgcgaacaatggagtactgaccttgcagcaggttaaagaagaacttatcaaggtatcacagccggaaggggagtggacaacacagtggtccatggcttattccggagaaagtggaaaggtgagctattggtttcattgcgattatgacagagaatgggaatattttataggagaatgacacttacgttttatctatacccttgcatcccctcaatattccctttattatagaaaacagatattgatctgcagttcccaggataagtaaatgtgatatggaaaaaggaaacgaattgaggagaaaagatatgagaagaaaagacagagaggtaaccgatgccggaaaaatcagggaagcgattgaggccagtcattgctgccgtcttggtttttatgatgaaggagaggtatatatcgttcccatgaatttcggctatacagaagaagaggaaaaaaggatcttctattttcacagtgccaaagaaggacgaaagatagaattgatatccagaacccattctgccggctttgaactggacaccaattaccagctgcatgaaggggaaaaagcctgccaatattctgccggttttctcagcgtaataggaaccggaaacattgattttgtggaagatcgggaatccaagaaatcagctctgcagacaatcatgctgcacaacaccggaaaaagcaactgggaattttcagaggatatgctcgatgccgttctgatttttaaaatggaagtaacccaaatatcctgcaaagagcatctgtaaagataggaatctctttcccgtccatccgcagggtttgtactatacgtcctggttccccgatttcctgcgcgggctcgttttcgctctgctaaaatgaagcggtactaaagttggcaaaggctgcaaaattaagtaccgcatttaaaggcacgtgcagggaacagcagccggacatcagggccaggaagtgtggaacaacgtttacggagagatgggggagtatccttccggaaatttttatagaagttattagataagttaatagatagtatattgactttttaacacgtgtattttataatccaagaatataataaacctgaaaacttaatatagtttcttttttttatgtatataatttacacgtgtaaacaatgggaaaggagcaggtaatactgtctcagtcattactttcggcgcaacaggaaagagcgcggcagtaaagagactggcggcggaaagtatgtgcagatgcggagcttcagaatgtatcataagcaggcattataatttatttaaacatattattataacgaagtaagaagaggaaaagcgtcctctgtacttgcgggcggatggaaaacaggaaaatcagaggaagtgaaattaccggactcattatggtttggtatattttacaggaggggaaatatgaaagagatcagtgcatcgtcggctaaaaaagcaaaagagcttctgaaacaaatgtccatggaggaaaagttatatcaattgtcaggatgtatgatatttgatatcgatgaaacttatgatcaatgcaggaatccattgtacggaaattacagaagtgcaggtcatttcatgcattggaaaaggaaggaacctgctgtgccgtcggaggttgccgcgcgaatcaatcaggatatacgtgccagtatcgaggctcagcctcatgggattcccccgcttattcatgaggaggctctgcatggagcacagtggggaatggcgacaatgtttccgcagccgattggcatggcgtccagctttgatgatgaactggtacaggaaataggggagatcatcggaaaggaatgtgcggcggtaggtgtgaggcaggtgctttctcctgtggtaaatattgcgagggactgccggtggggaaggctgatggaaacatttggagaagatgttcttctttcttccaacatgggagccgccatgtgtaagggaatccggaagaatggtgtgattgcgacattaaaacactatgcggataattattcctacggaggcagggattctaattcctccgattcttcggaacgggttatgcgtgaggtttatcttccgccgttcgaaaagtgtatcaaagaaggagatgctctttctgttatggccgcatataacagctggaatggggtcccctgttcctgcagccgggagctgcttacggatgttctgagagaggaatggaagttccccgggtttgtggtttcggattataaaggcgtggaaggtgtatgcagctctcatcatatgacagaggaagaatatcaggcggcagcgctatgtgttaaggcagggctggatgtgaatttaccggccgcatcaggtttttctcttctgaaaaaggcggtcgaagaaaagatactgagtcaggaggatgtcgataaggcggtatatcatgtcctggcggtgaagtttgaaatcggtctgtttgaacagccttttggagacgaaaaggaggcggagaaaatagtccgctgtgaagcccataagaagacagcactggaagcagcgagagaatccattatccttctcaaaaatgaaaacgtccttccctttgacagaaacagaacctgcagggtcggtgtttttggggcgagtgcggctgaggtgcctttgggcaaaaactattccgggccatataaacacagatgggaggcgcaggatgcgaaaacgccccttcagtttcttaaagaatatctgggagaagatacagaggttgtatattcaccggatttcaatgaagagctggcaaagggatgttcggcgacgctctattttacgaccattatcgaaggggaaggactggatcggtgtaatatttgtcttccttcggacaccatggtacagcaggtggacggcggcggactgatcgtagataaagcagaagcatcggttttcggaaatcaggaagaggatatccgtaagatgttccataccaatagaaattcggcggttattctgctgaacggttctcctgtggatatgacaggctggatcgattcggcatcggctgtcctggaggcatggtttccgggagaacaaggggcacaggcgatctgcgaaattttgtttggagattattccccttcaggaaagcttcctgtttcggttcccaagaatgttggacagcttcctctgttttatgcacataagccgtccggacgggggtaccactataatgagaatgacgggaatcctctctatccttttggttatggattaagctataccacatttggtttcggcagcttttcacggtgcataaaggaaggtgagatactaatttcctttgtgctggaaaatacgggacattatgacggcacggaggtggtacaggtttacgtgtccggcagaaactgcgatgtggttatgcctgttaaagaactgaaagcatatcgtagagttactttgaatgcaggtgaaaaggagaaggtctgtataacgcttccggctgcttcctttcagtattataaccgggagatgaagtatggcctgcataacggtgactttactgttatgacgggcaattcttctgaaaacatgttcaatgaattttctgttaagataagagagggaaagatatttctgaaggattcggaatagaagagaagtaatcaattataaaaatatatgccgcagataagtgctccggtgtcaaaaggcgggaatgaacagcaacggaaaagatgcataatcggtttatccataaaggtaggaattgcagagagccggaaaacaggatataatcagttataaataagagcgttgccggatcgggatgcataaatttggaggcgggtatggcaggaacaatacagcggattgcagaactggcaggggtgtccagaggaactgtggacagggcgataaacggacgcggcagggtcaatgaagaaactgcggccaggatcagtcagattgcggatgaactgggatatgttccaaagcacagaaaaaaaagagcggcgggagaacagaccggtatgcccggacaggccaaaacaattggtgtgattacgcagctgtgccattcctcctttatgatagaagtgaaccggggaatttcggaaatcagtgcaaagcttgaaaaacagggaatcagggtgtgcgtgaaggagagtgctaccgttgatgaggcagagcagcttgcggcgattgatgaactggaacgggaagggattgacgccctggcactgatgccggtggacagcgacagcatacggatccgcctgaaccgtcttgtcagtgaaaggaagattccccttgttacctttaattccgatattgtaggaacagaacgcatgtgctttgtcgggatagataattggaaaagcggcaggacagccgcggggcttatggggcttatgatgcatggaaaaggaagggtgctggggattaccggatatttttccaacggagccggcagccgcagggtggacggattcgtggaggaactgaaaaacagcttcccggatatcgggctgataggcgtgcagagcagctttgaccatacacaggaggttgaaaaaatcatagtcgacgctatgaatgcatacccggatctgggcggaatttttgtggcttccggcgggcaggagggagtaaagcgtgcatttgagcggttagggccggaaacccgcccctatgtgattatctatgaccttacgccgaagaatgaacgatatctgcaggaaggtgttgtggatttccttctcgaccaggaaggctacctgcagggctacagggcggtttcccttctggcggacaagctgcgctgggataaggaaccggcggaagagtacatgtatacggaaataaggatcaaaacaaaatataatctttaattgatatgacccttgaagggggccgatgctctgagcagctatgaatcatggattgccgtgattgataattactcagagcttttttaaatgagtaaaaaacagaccgaggtataaattgggggaatatgagtgaaacattttttgctttgcgtgctgttttgcggaaaagcacgcaaagtaaatatgtaaatactgacaaaataaatcccaaatatttgtgagaaacatggaaaatcaggaaagaacacaaacaatattgcagacacataatgcgtgtgatactataagaacataatcaggaaagagaaaagcacacacagacacataaaagcacgcaaaccgtgagaggagagcatagaatgaagtatgtggatttcgatcagaaaagaccgcttgatatcattcttctgggcaggatagccattgattttaatccggcctacaatgaacaggtgaaggaagagttcaagcctttgaagaaggtacatatgtttgaaatgtttgtcggagggtcgccagccaatattgcggtcggtgtgacaagacatggattgaaggccggtttttttgccagggtttccgatgaccagttcggagattttgtggtggattattttgaagaacagggaatcgatacatcccgcatcacccgctgcagaaacggagagaacctcggcctcacctttacggaaatgctatcgccgaaggagagcagtattcttatgtaccgcaacaaaattgcggatcttcagctatctgtggaggatattgatgaagagtatatacggcaggcaaaggcgattcttatttcgggcacctccctttccgaaagcccgtcccgtgaggctgcgctcaaggcgctgatgctggcgaaaaagaataataccaagatcatttttgatattgattaccgggcatataactggaaaaacagcgatgaaatctccatctattattctatggctgccagggaagcagacattattatgggttccagggaagaatttgacctgacggaaaagctgatatgtcctggcatgacagacgaagagtccgccaggtactggcagggctgcagggctaaaattgtggttatcaagcacggcatgaagggctccaccgcatatacggcagacggggagaaatactccgtcaaacccttcccggtaacagccaggaaaggctttggcggcggtgacggatatggctccggattcttatatggactgtatcagggctgggagcttatcgattgtcttgaatttggttctgcagaagcatccatgatggtgagaagcaacaactgttccgacgctctgccggggccggaggaggtccgggcatttattcaggaagaaaaggaactatatggagaaatgattgccagagtataataattatgcctcaaaaaggagacagcagactatggaaaaaacaataagattgacggttgcccaggcaatcgtgaggtttctggatcagcagtatgtgctgatggatcaggaagaaacaaaatttgtggaaggcttttttactattttcggacatggaattgcggtgggactgggggaagcgctggataccaatcccggttccctgcgcgtgatgcaggggagaaatgagcagggcatgtgccatgcggcaatcgcattcgccaagcagagcaacagaaagcggatcatcgcgtgtgcgtcctccgtggggccgggggctgcgaatatggtgacggcctgtgctacagctacagtcaataatatcccgctgcttgtattcccggcggataccttcgcttccagacagccggatccggtcctgcagcagttggaggtaagcggcagccttgcggtgtcgacaaacgatgcttttaaaccggtatgtaaatattgggacaggatcacgaggccggagcaggttatgacggcactgatcagcgcaatgagggtgcttacggatccggcggaaacaggggcctgctgcattgcgctgccgcaggatgtggaaggggaggcctatgattatccggcctattttttccggaagcgtgtgcatcggattacccgtcctgctgcggtggaagaagaactggaagatttggcggaggttttatcccgggcagagaaacctcttatcattgtgggaggcggagtaaaatattcccaggcaggagaagctgtggagagcttctgcgaagagtttaaaatccccttcggagagacacaggcggggaagagtgcctgccgatccagccatccatactgtctgggaggaattggcgtgacggggactctcgcttccaatgtgattgcaaaggatgccgatgtggttctggcgatcggttccaggctgtcggatttcacgaccggctccaagcgtctgttcggcagggaggatgtccggtttctgacgattaataactgccggttccacgcttataagatggatgccgtaaaggcggtgggggatgcgaaagcgacactggaggcgctggcggaaaagctgcgcggacgcgggtatatatccgcctacagaggggaaatagaagcggcgaaggaagcctgggatgcggagcttaagcgtctgggagagattacatataccggtgaatcctttgaaccgctgattcacgcacgggatcctcgtacgataccggaatttgtggaactgacaaaagggcacatcacacagactgccgctctggctgtgctgaaccgccttgtggagccggatgcgacggtcattacggcaggcggttcccttcccagctgcatgcagcgcatgtggaggacggataaaaggggcggctatcatgcggaatatggctattcctgcatgggctatgaggtggcggcgactcttggcgtcaagtttgcggaaccggattgcgaggtgtattgtgtggtcggggattccagctttcagatgatgcattcggaaattatgacgattatgcaggaacgcaaaaaggtaaacatcctgatatttgacaactgcggcttcggctgcatcaacaatctggagatgaataacggaatcggaagcctggcgacggaattccgctatacggacggcaaaaaaccgacgggtgatttaatctatgtggattatgcgaagatcggagaggggtacggccttaaaacctatacctgcacaacggcggaagaactggaggcagccctccttgacgctaaaaaggagagcattgcgtgtctgtttgatttgaaggtgcttcccaagactatgacggatggctatgaatcctggtggaacgtaggaatagcgcaggtttccgaaaaggacagtgtcaggaaggcctgtgaagatgtcatgcagggacgcagggaagcgcgtgcctattaaaaacgggaggaagaaggatgggaaaagtattcggatatcctgtgttcgatgagaacggggaaaaaattctgacgacttatgataatgaatacagcgaaatgaggatggatatccgcgtttaccggatgaaaaagggggaagagagaagcttcctgaggaaaggagaggaaacggcaatccttctgctttcgggaaaaatccggttttgctgggacggaaaggaaacatcggtatccagaaaggatgtattctcacaggggccatggtgcctgcatatctgtacggaagccgaagccgccgtaaaagcggaggaggacagtgaaatcctcgtacagtgtactaaaaatgaaacagaattcgcagccgtgctttaccgcccggaggatgcgccctggaaatattcctgcgtgggtaaattcgggaatgtggccaaaaggcgtgtcaatacgatcttcgaccatgacatcgcaccctggtccaatatggtgctgggagaggtgctcaatgacaggggcaactggtccggttatctgccgcacaggcatccgcagccggaaacctattatttcctgtttgaccggccggaagggttcggtgccagctttgtgggagatcaggtgtttaagagtacggacgggagtttttccgccataccgggaggagagctgcatccccaggccgcggcgccgggatttcagatgtatacctgctggatgatccgtcatctggagggaaatccatggctgcagacggatcgctgtgaggatggaaagtatacctggctgcatgatgcccaaatctgacagatgctgcatggaaaaaagaggagaaaaggagaagaaaatggcgagagaatttatcgtgccgggacgcattatttccggtgcaggagcgttggatgccgctggcgcggctttgaaggagatgggaaaaaaggctctggtggtaacggacaaggtgatggtgcagctgggaaactgtgccagacttgaagcggcgttggccggacaggggattggctgtgtggtttatgatgaaatcacgggcgagccgacagacatcatgattgaaaacggacttcgggtatatcaggagaacggctgtgatttccttgtcgccctcggaggaggaagcccgattgattcgatgaaggcaattgcgtcccttgtaaaaaatggcggaagcatttccgattatatgggtaagataattgatgtaccggtaccgcccatggcagccattccgactacggcaggcacgggctccgaagcgacccagttcacgattataacggacaccaaaaaggatatcaaaatgcttttgaagggggccgttctgatgccgaaacttgcggtcatcgatcctcagttcaccatgaccgcgcctcccaaaatcactgcggcaaccggtctggatgccctgtgccatgcaatagaagcatatacctccaggaaggcccagacgctgtcggatacctttgcactctccgcggtaaaacgtatttttgaatttcttcctgccgtttatcatgacgggaaaaatgaggaggcccggatccagatgtccgtggcggccctggaagcgggaattgcatttaataattcgtccgtgactatcattcatggcatgagccgcccgataggcgctcttttccatgtggctcacgggctgtccaatgccatgctcatgaaagagtgtctgtcctttgcgctggaaggcgcagtaagcaggttcgcggagcttggcagagcggttggcgcggcaaaggagagtgacccggacgcagaggcgggcagcaggttccttgctgcggtacaggaaatgataaccgggctggagataccgactctgcaggaatacggaatcgacagagaaactttttattcacagatagaaaaaatggcacaggatgccatggacagcggcagtccccagaatacgatgcggcagccggatcgccaggccgtgatggatatttataaaaaaatctatgaaggagagtaagaatatggtaaaggtagggattatcggagcgggaagaatcggaaaggtacatatcacaagtatcagtacgagagtcagggatgccgtcatcaagacagtggcggatccgttcatgaatgaagagactgcggcctgggccaaaggaatgggcgtgcagcatacaacgaaagattatgaggagatcatccgcgatcccgaaatcgatgcggtactgatctgctcttcaacggatacacactcccccatttccctggaggcaatccgggcaggcaagcatgtattctgtgaaaaacccatcgatcatgatgtggaaaaaattaaagaagtggcagccgcgctggaagggacgaaagtgaaataccaggttggttttaaccggaggtttgatcataatttcgaagcggtacagcgggcagtggcagaaggaaggatcggcaggcccgagatcatcaaaatcacatcccgtgatccggaaccgcccggaattgattatgtgaaggtttccggcggcatgttcctggatatgacgatccatgattttgatatggcgcgtttcctggcgggatgtgacgctgaggaggtttatgtgcaggccgccaatctggtggatcccaaaatcggggaagcaggcgatgtggatactgcggttatcacacttcagatggaaaatggcgctattgcggtgattgacaactgcagaaaagcggtatacggatacgatcagcgggctgaggtgtttggttccgaagggatggcggccatcggcaacgacagccagtccagcgtacagatcagcaattcggacggcgtgacgggagaaaagcccctgtttttcttcctggaaagatacatggatgcctatggcaaggaaatcgcggcttttattgatgcgattgtcaatgatacggaaacccctttaggtgttatggacggcctcaagcccgtactcatgggactggcggcaaaaaaatcctgggaagagcacagacctgttaaaatctcagaaatcatgtgatgatgcatatgattttcaaccggaggaaaagagatgtttgataaaaataaagtaaagctggggatcgccccgatcgcgtggacaaatgatgatctgccggatctgggaaaagaaaatacctttgaacagtgcgtgagtgaaatggcactggcaggctataccggttcggaggtgggaaacaaatatccacgggatcccgaggtgctgaaaaaggcgctgcagctgcggggaatggaaatatgcaaccagtggttttcctgctatctgattaccaaaccctttgaagaggtggaaaaggaatttcgtgcgcagctcacttttttaaaggaaatgggcgccaaaatcatcggtgcatccgaacagagccacagcgtacaagggcagcaggatgtacctgtattcggacataaatatgtgatgaatgatgaagaatgggacatcttctgcagcggaatgaacagactcgggaaaatagcgaaggaggaatacggaatttccctcaccttccatcaccatatgggaacggtggtgcagaatccggatgaagtggaacggatgatggaaaatacagatccggcgtatgtcagccttttatatgatacgggacattttacctactgcggagccgatcctctggagatggtccgaaaatatgcgggcagaatccggcatgtacacttaaaggatatccgtcctgaaatcgtggagaagataaaacgggagaagttaagctttctggatggcgtccgcctcggtgccttcacgatacccggcgacggctgcattgattttgacccgattttcaaagtcctggaggatacgggctacgagggctatatgctggtggaggcggagcaggatcctgcgaaggcaaatccgctggaatatgccatcagggcgcgcagatttattgcggaaaagacgggactgtaatttttgacgacataccggatggaaaaggagaaaaaaacggactttaaccattaagaaaccttcataatatcttaagctttccttatatggacaatgaatacggcatatgctatgattaactgtacgtgataaatttgctgctgcccgggaacagcccggaacatacgaaggattaacagatatggaaaataatagaaaaacgtcagggaatcatagaagaaaaaaagggagccgcaatcatggaatcgccatgtatccgactcttgcggtgagatggataaagaagaataaggcgatgtcggcagctcttgcggtgctgctgatagtagttgcaggaaccggcgttctggtgggctggggaatgggaagaggaaaagcgcagaaggatgcgggcgaaacgcaggcttcggcggaaaccattccggagcagaccggagaagagcaggagagcacggtgtcccctttgctggaaaatgaatatccggaggtcaatgatctgattttaaagtatcaccaggcgctgcagtcggatgatatggatacgttaaaaacgctgctggattatgcggaggacaaggaactgctccgtatgcaggaaaacggctctcatattgagtcatataataatattgtatgctataccaagccgggcctggatgcggacagttatgtggtatatgcctgctatgatgttaaattcgttggtttcgatactctggtaccgggcctgacaccgttctatgtaagccgtaatgaggaaggcaggtattatatccgggactgggagcacaatccggatgaagcggcctatgccaatgaggtaacggcgcaggaggatgtggcggctctgtatgatcgcatcaggaacgaatccgcagagatactggcaggggatgaggagctttcccaatatctgtcaaactatctgaatgatatgatggtagcggtcggtgaagcgctgaatgaaaaggagaatagtccggaaagtacggaggctccaacggaaagcgcggcggcacaggaaagtgaaagcaaatcggagccggaagcttcccagccggcccagacgccttcccagccggcatccacatctgttaatgttcccaacagcggggaatttacggtgtcggaaacagtgaatgtcagaaagagcgcaaatgaaaatgccgaaagaataggggtatgctattccggcgaaaagctggaaatactcatgaaacaggcagacggctggacaagggttaagttcaacggacagaccggatatgtgaaatcagatgttttaaaataataaaaatacagacaggccgctgtccttttccgggacagcggcctgcctgtatgtgcggcagtccggatacgtcaggagttataagcttaactccggccgaataatttcttgccgacaaaaatgaaaatacatgcaccgattacggaaacaatcaggttggcgaagaagccgctggcataaaaaccaaccaggcggaacagaaaacttccgatcattcctcctacaattcccgtaatgatattgcgcagggtaccgccctgcgtattcatgatcttactggctatccagccggcaatcgcaccatatacaatagataatatgaaagataacattttcaggcctcctttatcgtttgtctgttactataataaacatttttttgagaaaaagcaacaaggattaatgaaactgtccttctgaaaccaggcgggctatttttctattgcatttttcgcgcagagagagcagccaggcggcttcatgaggatagctgttgaaggtaatgggagcctccaggccctcctccaaaagagcgagaacggtttccctgtctgtcagttgttccagcagctgcagggccctcatatcctgcaggccttccatcaggacctccgcacgtatggatgcgatcgggccgtcttctcccggatatacaagggatgcatctcccgaaggaaatgcgcaggcggcatcggtcacgcaatagggattgatgggataccgggaaagcatggaattccagaaattaaatccccattgcagaaatccgtggatctgatatttataaagctgtacgcccagaatacggttcctctgggagggcatgcagaagaagcggtttgacacctcacgaaactggccgcagcagtaataggtccacaggcccggcacatgattttcaagaaaaggccggatatggtcattgctgcaaacaggcacccctaccaggccctgttcatagaattcataatcggacagggcatccatgataggaaggccgtcgatctgtgattccagaagcttcttggcatacaggtatgcgggaatatgctccttgctcggttcgtcggaaacatggaaatagcagcgatcctgcagcttatgggtgcggatgaagtccatgaggcgcggcaggaaagcttccagaaattcccggtattcgtcactcgccgcatcggtatcccagccgaatatctgcctgcagccctcttttttcccatttgccggagagccttcccaggccatgatcttaggggcatgtccggctccccactgggtaaataaatgagaaaattccagatagcggatgtggcagcgttcacaaagctccagccagcgttccaatttttcaaaggaaaaggtataaccgttctcttcctggtatacatcgataagctgcaccgtagtgcgttctccccccggggcggtatccagaggcggtgtgaaaagaggcgtcagaatcatgttgactccatagcatgcggcggcctccatatatccggaggtaagctcccagtatttttcgctgaaaacaggaaccttataccagtcggcaatacaatctgtatgaaaccattccgtatggatgagagtctgttccggaaggcgggcattcaggcgttccagaacaaaagtacagctgttaaggactgtgccgtcttcttcggtaatggcgattgtaagatcgtaggaaccggaaggcagggaacattccgcaggaacggtgatccagaggctcctccattgccccggcagcagagtgatatccgatatgccggaataaaggggatccggataaaggccgggtgtggtccgcagcacaaaatcatccccgtccggaaaaataggaagttcgctgggagccaggcctacctgtcttataataacatcatcggccaaagctcccgacaactggatcccggctttaaaggtgagcgggccttcccagcaataggcggcctgaaaggaaaaacgctcattaaggagcatgtcggcgccggtatattcagcctgcggctgaaagggttcatccggaaagattttctccagagaactgacggtgagtaaggttaattttttactgtccatatgcaatccccctgtgtgattcattataaaaataagaatatcaaagaatcggggaaaacgctatattgccgcagaaaatgatgtaaaaagtgcaaagaaaagtgccgatatggatagctggaaaatggaaccttccggtatcccgaagcttgctgagaagtattcggcttaaagaaggcttccggcatattcccggggcgtgcatccggtgattttcttaaatgttttcgtaaaatagctgggactggaaaaaccgcagcagctgcatatttcggtgatgtttttttcaccgcttttcagaatgaggcaagcgcgtgaaatacggtaatgaatcagatattgaacgggagactgccggatgattttccggaaggaacgaagagcctcccgttcgcagatattggcgctggatgcaatttctttcagggtaacaggctcctggtaatgcaggcgtatatattcaagcataattttaagcctctgcatttccagggaggtttctgaaaaagccccggtgagagaagctttacaattttcatatacaagaaaaatcatacgggacagcgcttcgcggaccatgaattcataaccctcccggcgttcggataacagctgctgagccaaaagaatctgcccgatagcttccttctgccagggaacagaggggcggaaaagtattgcatccaattcctggcaggaggtgacagggcgcagatacttctgccagagaacgctgtcggtggttccgtacagaaggcggccgtgaaaaacaagatcgcgtttttcgcttgcgggagcggtacggacgggagccagagtgtgcaggacgcctgaattaataaaaatcccgtcaccctcctgcataagaaaggttttccggcctgcggagagctgagtgctgccccggataacgactccggcttcgtattcttcatgccagtgccagggagtatatccaagggagggatttccgctgtagcagccgcagggaaaaccggcggttccgtgtacccttaattccatcttgtcctccgatacgatcaccgattgaaaatcctccatgccggacgcctcctgtttctgtttttgtcgtttttgttatagtatatgtccattctgttatggatgcaagaagaactatccgatactattatctgggcattttaagaagaaaaatttcttccccggcagtagattggacaggaggattaaaaatgactaaggatatgacaaagggatccccttttaaattgatcataggatttgcggttcccatgtttctcggcatgctgtttcagcagttttacagtatggtggatacgatgattgtgggaaagctgctgggcgtcaatcccctggcaggagtgggttctaccagttccctgaacttcatggtaatcggtttctgtaccggtgtctgcaatggctttgccattccggtggcccagatgttcggcgcgaaaaaagaatcggatctgcgtaaatatgtggcaaactgtacatggctgtgcgcaggcttttccgtaattctcactttgctggtggtcattttctgtaaacctatcctgcaccttctgaggactccgacggaaatcttcgaatatgcctatgtctatattgtgattattttctgggggatcccctgtacctttttatataatatccttgctgccataatccgttctctgggggattcccggacgcctgtggtatttctggcagttgcttccatattgaatataatactggatcttgtttttatcataccttttcatatgggggtggaaggcgcagcgcttgcgacggtgatttcacagggtgtttccggtgtggtatgtctgttttatatgaagaaaaaatttgcagtgctgaaaatcagcaaagcggaatggaggccgcagcccctgttcatgaaaaacctgtgtatggtagggattcccatggggcttcagtattccataaccgccataggaacactggtgatccaggcggcggtaaacggccttggggcggctgccgtggcgggagtgactgcggcacagaaaatctacgctttcgtatcctgtcccattgaatcgctcggggcaaccatggcgccctacagcggacagaatatgggggcgggaaagctggaacgtctggaaaagggtctggtggcggcttccctcaccggtttcgtcttgtccggcctggcattggtgctgatgtggctgtttgggaataacatgtcccttcttttcctggataaatcagagactgaggtcatggcctattcctatcagttcctgatgacggcttctgtgggcttctgccttctgacgcttgtaaatacggtccggtttaccattcagggaatgggcttttccggttttgccatgacggcgggcgtgctggaaatgatagcaagaactctggcgggtacggttttggtgcctttgattggtttccgggggatctgccttgcccacccgcttgcgtggttatttgcggatgtatttttaattcctgcatttttgcactgcaggaagaagctggagaggatgatgaggggagaaggcgcggccggagcttctgtgaacagctgaaaaagaatacttacgaaacggttcccgggtattttggcagggaaccgtttctttttccgtattcaaattctctttttgcaccaatgctccagccactggatgatctggtacagcgccatggcaatgacacacaggatgataatggatgtaatcaccatattgagctggaaaacctggcttccataaatgatcagataaccaagcccccttctggctgccaggaattcaccgatgataacgccgacaagggccaggccaatatttaccttcatcgtgctgagtataataggaacggatccgggcaggaccactttaaataaggtggttctccggttgcctccaagggtataaataagctttattttttcctcgtccacctgacggaagccggtgtaaagattaatgatagccccgaagatggccacagaaataccggcgacaattatagtattcattccggttcccagccatacgataagcagcggcgccaaagcggatttgggaaggctgttaaggacaacgaggtaaggctccaggatttccgtcagtttcgtggaataccacagcagtgtggcgcagatcatgctgaaggcgaaaaccaggagaaagctgagtatggtttcgtataaagtaacgccgatatgcatgaataaggagttcttttgcagcatagttataaagcaggtaacaacccggctggggctggaaaagaagaaggagtcaatgattttcagatcggcacacagctcccagacagccagaaagacaataagaatgaagaaacgcataaaagtaaccattcggtgatgcttcctgtgatcggctacaaagcgttcctgggcagaggcggaaagctctgccggggtcatgtttttcgttgattttttatgattcatctgtcagttcctcccaaagctgattaaaatagtccttgaattccggcgcgtttctggaagcgagcagggaatcatctttaagggtgaggtgaatagggatttcagcttttacccgtgcgggacggttgctgagaacaataaccctatccgccaggctgacggcttccgaaaggtcgtgggtaattaaaactgcggttttcccggcggaacgtatgatccggcagatatccgcggacaccgtgagacgtgtctggtagtcaagggcgctgaagggttcgtcgagaagcaggatttccggctccagggccagtgtacggacgagagccgcacgctgcttcagaccgccggacagctcacttggttttttatgaagaaaaggagaaaggccatagtcatttaccatggaaagaaccttttccttcttttcgggagtcagctgtttgttgatttccagtccgagtgtgacatttttataaatatccctccattcgaagagatgatcatgctgaagcatgtagccgattcccggctttttatcatgcggatctttggtataaaaagtaatatcgccggattcaggctgaagcaatccggcaatgagggagagaatcgtagattttccacagccgctgggaccgacgatggccaggaattctccggttcggaccgaaaaggatatgttgtcgagtgctttgatttccccgttcagactgtgataggagaaagctatatttttcaatgagagtatgatgtcttccatgtcaatcctccaatctggccggaaaagaaaataccgggtcccatggtggcaattcggttccggacagttatataacatatcatatgaatccggcgggaatttgttccttgccggtattttttcgggaataccggcataaactgatggctttgccaatatccccgaaatgtatgaactatgtaaaaaggatttattttagtggtggaggagggcgtaaaatggtaaaataaattcaggataataacgactgcggaaacaggtggctggcgagagagggggcgcgggaatgcgtgggtggaagcttgtatggaaagtgctctggcctgttttatggtatttaggggtaatgggagcggcggccctgctgtgtccccggaggttctctgtgctggaggtggccggtgtggcggcgggagctgcggcggtgacattgcttctgggcggacggctgtacagaggaagaggcttttgggaaaatctgggaagcggcggtaaggcgctgggatatggatggctgctgattccagcaggaatagcggtgtgcattatgctgaacggcctgcttattctgttcggtctggaaagtacatccggcatgtatgacggaagggcggaaatgatatacgcaagccgaatgtgggaacagctgctgatatcctgtgtactgattccctttgccgaagagctggtcttccgggaactgggattcggaagactgcgtaaggaatgcggaccggctctggcggcaggcataacagcggtgctttttggaatatatcatcttcagctggtgcagggcctttacgccgtatgcctgggattgctgctggcggcggcctatgagaaatgcggagggctgggggcggcgtttctggtgcatgcagtttccaacctgacagctgtggttttgtctttagaaggggagaaaagctggctttggggaaaaagtctatttgtagtttcagccaccctgatttccggccttattcttatcctgtgtgtccgaaagatgttgaaagcggaggggacggagacgaaaactttattgcaataaagttcattttatggtactatcatttttaaattgaaattatgaggtactttttatcgaataaagggccggatttgtggcggaatggaggatattatggcacagctctggggcggacgttttacgaaggaaacggacaagctggcatatcagttcaatgcatcaatacattttgacaggcgtttttttgagcaggatatcgaagggagcattgcccatgcggtgatgctggagaagcaggggattcttacacaggcggaaaaggatgccattgtgaaggggctgaccggaatacgtgaggatgtgaaggaaggcagtctagttattacggatgaatatgaagacattcacagctttgtggaagcgaatctcattgaacgtatcggcgatgcgggaaagaagctgcatacgggaagaagcaggaatgatcaggtggcgctggacatgaagctgtatgtgcgccaggaaattctggaaacggacgcttatttaaaggaactcctggagacgctgatccgtcttatggaagaaaatatggaaacctatatgcccggtttcactcatatgcagaaggcacagcccaccactctggcccaccatctgggcgcttattttgaaatgtttaaaagagaccggctccgtatgaaggatattttcatgagaatgaactattgccctttaggggcgggagccctggcgggaaccacatatcctctggacagaagctatacggcttctctgcttggctttgaaggaccgacgcttaacagtatggattccgtgtcggacagagattatctcatagagctgttatccgctctttctactataatgatgcatttgagccgtttctccgaggagattatcacatggaattccaatgaatatcactttgtggagatcgacgacgcctattccacaggaagcagtatcatgcctcagaagaagaatccggatatcgcggagctgacccgcggaaagacaggacgggtttacggggcgctgatttccatgctcacaacgatgaagggaattcctctcgcttataacaaagacatgcaggaagacaaggaaatgacctttgacgctattgatacggtaaaaagctgcctggttctttttaacggaatggtaaagacgatgcgctttaatatggctgttatggaaaaaagtgccgtgaacggatttaccaatgccacggatgcagcggactacctggtaggcaaaggtgtacccttccgggatgcccatggtattatcggcagccttgtcctttactgcatcgggaaaaacacaagcattgacgccttaagcctggaagaactcaaaacaatcagtcctgtttttgaagaggacatctatgaggcggtttccctgaaaacctgcgtggaaaaacggctgaccctgggagctccggggatggatgccatgaaggaagttatcgcgattaataaggaatatctgaaggaagaatgggagcttcagcccggcattttaaaacagccgctggagaaacaggttctgtaattatctttatttagaatatatatttaagaaagatgaggagagaaaagatgagcgagaaactgaaagtaggtatcttaggcggaaccggtatggtagggcagcgttttatttccctgctggaaaaccatccctggtttgaggtgaccacaattgcggcaagccccagatcggcgggtaaaacctatgaggaggctgtgggtgacaggtggaagatgactacccccatgccggaagcagtgaaaaaaatagcggtaatgaatgtcaacgaagtggaaaaggttgccgctgaggtggattttgttttcagtgcggttgatatgaccaaagaagaaatcaagaaaatagaagaagagtatgcaaaaacggaaactcccgtggtatccaataacagcgctcatcgctggactcccgacgttcccatggtggtgccggaaatcaatccggagcacatgaaggttattgaattccagaaaaaacgtcttggaaccacaagaggctttgtggccgttaagcccaactgttccattcaaagctatgcgcccgtgctcaccgcctggaaggagttcgagcctgtggaggttgttgcaaccacatatcaggcaatttccggagcgggtaaaaccttcaaggactggcctgaaatggtgggaaatatcatcccgtatatcggcggtgaagaagaaaagagtgaaaaagagcctcttcgtatctggggtaagatcgaagacggcgtgattgtccctgcgacctctcctgtaatcacctgccagtgtattcgtgtgcctgttctgaacggacataccgcagctgtatttgtaaaattcaacaaaaagcctacgaaggaacagttaatcgaaaagctggtgaatttcaaaggcgtgcctcaggaactggagcttcccagcgctccgaagcagttcattcagtatcttgaggaagataaccgtcctcaggtaactatggatgtggattatgaaaacggcatgggagtttccgtcggccgtctgagagaagatacggtatatgactggaaatttatcggactttcccataatacggtacgcggcgcagcaggcggagccgttttatgtgcagaactgctgaaagcacagggctatattacaaagaaataagtcctggtaaaagaggtataatttgggcaaggatttatttatagcggaaaaacctagtgttgcccgcgagtttgcaaaagcattaaaatataatatgagcaatcgggatggatatatggaatcggaacaggctatcgtcacttggtgcgtaggccatctggttaccatgagctatcccgatgcttatgatccggaattgaaaagatggacgctgaaaacgctgccctttattccgaatgaatataaatatgaagtaattcccgcagtgaagaagcagtttgatattgtgagcggccttctgaacagggaagacgtagccagaatttatgtctgcaccgactccgggcgcgaaggcgaatatatttaccgtctggtggaacagcaggcgggtatcgatgaaaattcaggaaaagaaagacggcgggtctggatcgattcccagacggaagaagagattctaagagggatcaaggaggcaaaggagttatccgcatatgataacctttgcgatgcggcttacctgagagcgaaggaagattacctgatgggaattaatttctcccgtgtcctgacgctgaaatacggatatcctgtgaaaaattatctgaaacaggataaagccgtgatttcggtagggcgggtaatgacctgtgtcctcggaatggtggtgaacagggagcgggaaatcaggcagtttgtcaagactcccttttatcgtgtgacaggccggttcgccctcgcttcttccggggaggagacgaacggagggcgcagctttgaaggcgagtggagagccgtggaaggctccgcctggttccagtctcctgctttatataaagagaatgggtttaagaagaaagaggatgcgcagaagctgatatcctttttggaagaagaaccccaaaaagcgccggtcattgagaaaattgagaaaaagaaggagcagaagaatccgcccctgttatataatcttgcggagcttcagaatgactgttccaaatattttaaaataagtccggatgaaaccctgcgcattgtgcaggagctttatgaaaagaagctgacaacataccccagaacggacgcccgtgtactttccagcgctgtggcaaaggaaatcaacaagaatatcggcgggctgcgtaattaccagccggctgcggcttttgccgcgcaggtgctggaacagaaaagctggcagggaattgccaaaaccagatatgtcaatgacaagcagataacggaccattatgccataatacctacaggccagggtctgggagccctttcctccgtttccgcaacggcggctaaggtatatgaaatcattgtcagacgtttcctgagtattttttatcccccggcggtttatcagaagatatccctggttatcagtattaagggagaacgttttttcgccagctttaaggtactcatggatgagggctatctgaaggtaacccagttttcttttgctaagaaaaaagaggagactcccaggcctgaagaaggaaaaaaggaagggcaggagaacgacggccaggaagaagatatcaaatgtgatgcagacttcctgaaagtgctgcagagcctgaaaaagggagaagagctttcctgccagggactggaaatcaaagaaggcgagacttcacctcccaaacgctataattccggaacaatcatccttactatggagaatgcaggacagtttgtagaggatgaggaactccgtgcccagataaagggcagcggcatcggaacaagcgccacgagggccgagattctgaaaaagctggtttctattgattatctggcgctgaataagaagacacagatcatcacacccacacagatgggggaaatgatttacgatgtggtatccgattccataaaaccgctgctgaatccggcgctgacggccagctgggaaaaagggctgacgatggtggcggaaggcacgatcacatcggatgaatatatgaaaaagctcactgattttgtgggaagaaggacgaatatcgtaaaacagctgaataatcagcagattctattccggcagttcgatgagaatgcaaaatattatgcgaaacagcctgccaggactgcagcgcgtaaggaggatcccaaaaaggaaccggaagcccgtaaggcataagcgaagggtggaagaggcagtccggccggaaggaaaacagcagttggcaagtgtggtagtacacagataggagcagacatggaacaatgtaaaatcattaatctgtatgacctgaatgaaacgattgcggcacctgtatttgaaggctttacctatccatgggaagtccttcctgaaatcaagtcctttattccggagttaggcaaaacgctgccggcagacaggtttgacaaagtgggagagaatgtatggattgccaaatccgcaaaggtggcgccgagcgcgtatattaacggccccgccataatagatgaggaggcggaaatccgtcactgcgcttttatcagaggaagcgcgatcgtgggaaaaggcgctgtagtagggaattccactgaacttaaaaatgtgattcttttcaataaggtgcaggttccccattataactatgtaggcgacagtattctgggttacaagtcacatatgggagcgggttccatcacttctaatgtaaaaagtgacaaaacgctggtagtggtaagatgcaatggcgaagaatgccatacaggcctgaaaaaattcggagccatgctgggtgacaacgtggaagtgggctgcaattccgtattgaatccgggaaccgttataggacggggaaccaatatctatcctacctctatggtgaggggctttgtgcctgccgacagcatttataagacaaaaacagaaatatccgaaaaaagccatgacgaaggaaagacagactgacagagcggatgaaaaaagcggaaccggctgggtaagacagccggttccttttttgggttcttctgctgcggctgctgcgcagaatatactgtgcggaatatggaaatttatattgacgaatatatatttttcgtgtatagtaactgttagacgcgttaatgcttgcacgcgctaaagcgtaaaaccggaaagaaaagaggaaaatgttatgaaaaggttattggcaatagcgactgcctttactatgacggcagttatgctggcaggctgtggaagcagcacaaatgacagcacaaatacttctgcggcatcagaacccgcagcacaggaatcagtacagcctgaagcggccgagagcagcgtagctgaaacaggcgaagccgcagatgcccagacagatgcggataaggtataccagattggaatctgccagcttctgcagcatgatgccctggatgccgccacattaggttttaaagaagccttaacagacaagcttggagaagataaggtaaaattcgacgagcagaatgcatccggtgattccgcaacctgtgcgacaatcatcaatcagtttgtatctgcagacgtggatctgatcctggcgaatgccacagcatccttacaggcagcagcagccggaaccggaaccattccgatcctgggaacatccatcacggattatgcgaccgctctggaaatagatgactggacaggaaccacaggtaaaaacatttccggaacatcggatcttgcgcctctcaaggaacaggccgcaatgcttaatgagcttttcccggatgccaagacaataggcctgttatattgctccgcagaagccaactccgtataccaggcagacacgattcaggaatacctggaaggctacggatatacctgcaagacattcacttttgcagactccaatgatatcgcttccgtaacgaccaatgcaaccggtgaatgcgatgtaatctatgtaccgacagacaataccgcagcttccaacacggaagtaatcaataatgtatgccttcctgctggagttcccgttattgcaggcgaagaaggtatctgcaaaggctgcggcgttgcaaccttatctatcagctattatgatatcggctacaaggccggagaaatggcagtggatatcctggttaacggagcagatatcacaacaatgcctgttgagttcgctcctaatgtaaccaaagaatataatgagactatttgtaaagaactgaatattacagtgcctgaagactatgtggccattaaggcggaataaccagtattttacataacatgcaaagcggacagatgcctgaacggcactccacaaaagcggttaaaaagccctgctttttaccgctttttgttgtacaatgcattttataaaaaaagagatatcttttcagaataaattcctttataatagatacctgtgaggcctgtcaagggcttaaatattgaagatacggggaggtaaatgacgtgaacattatgtcactcttaaatgcgctgccaggcgcctgcgcccagggattgatctggggaattatggcaataggtgtatacataacctacaaaatactggatctggcagacttgactgtagatggaaccatggctaccggaggggccgtatgtattatgatgatacgtgccggccattccctgggcatttctcttatatgtgcggtgctggccggtgccctggcgggattggtgaccggtattttccatacatccatgggcattccggccatactcgccggaatactgacccagcttggcttatactcggttaacttaagaattctcggcaacagctccaaccaggcggtaggagtggataaatacgacttgctggtatctctgcgatacataaagggcgtgcccttttaccagaataccattcttatctgtattgttatccttattatattgattgccttgctttactggtttttcggtacagagctcggctgctccatccgtgctaccggatctaacccgaatatgtccagggcacagggcattaataccaatttctgcaaaatactcggtcttatgctttcaaacggaatcgtagctttcgccagtgcactgtatgcccagtatcagggcttcgcagatgtaaatatgggacggggagctatcgttatcggcctggctgccgtaattatcggagaggtaattttcagccgcgtccgtggaaattttgcattcaagctgttttcggcggcattgggagccattatatattatattgtacttcaggtggtgctgtggctcggtctgaattccaacgatctgaagctgttctccgccctggtagtggccctgttcctggctatcccttatttaaagggaaagtacttcaataagccggcaaaaaaaggaggtgctccccgtgcttagtatatccggaataacaaaaacatttaatgctggtacgatcaatgaaaaaacagcgctgaatggtttatccctcaagctggaagagggagatttcgtaacagttatcggaggaaacggtgccggaaaatccaccatgctcaatgcagtggccggggttttctccgtagatgaaggaaacatcaccatcgacggaatcgatgtaaccaagctgcctgagtacaaacgcgccaaatatctgggacgtgttttccaggatcccatgacgggtacggcagccaatatgcagatagaagaaaatctggcattggcatcaagaaggggaaaccatcgtaccctgcgttccggaatttcccagaaagaacgtgcacagtaccaggaacagcttaaaatcctggagcttggtcttgagttccgcatgacaagcaaagtaggccttctttccggcggacagcgccaggctctgacactccttatggcaaccctgaaaaaaccccgcctccttcttctggatgagcataccgcggcattggatcccaagacggccgcgaaggtattggaaatcacggaaaaaatagtggaaagagatcatttgacgacactgatgatcacacacaatatgaaggatgccatcgcccatggaaaccgcctgatcatgatgcatgaaggaagggttatttatgatgtggcaggggaagaaaagaaaaatcttcaggtgtccgacctcctcaaaaaattcgaacaggtcagcggaagtgaatttgccaacgataggatgatgctgaattagatacagagacagcggccttgcgggccgctgttttgcattctttccgctgcttcgacaatactttgacaatttttttcaaaaaggctggatttttgacttgaaatatgagaaaataatacgagcgattagggacaggtacttttgcggcctttttgccgtgtaagtattttgttatcaataaggtgcctgctatcaggtaccactgtttgctaatacaatctacatatcgaaaggagttttcacatgatctattcaaaagaagttgaagaaatgtgtccagtagcacaaggcgttgctcacggctgtgctccgatccctgaagaagcaaaatgggtaaaatccaaagaagttaaagacatttcaggccttacacatggtgttggctggtgtgcacctcagcagggtgcctgcaagcttaccctgaatgttaaagagggtattatccaggaggcactggttgagacaatcggatgctccggtatgactcactccgcagctatggcagcagagatccttccgggaagaacggttctggaagctttaaatacagatcttgtatgtgatgctatcaacaccgctatgagagaactgttcttacagatcgcttacggaagaacacagagtgcgttctccgaagacggacttcccattggcgcaggcctggaagaccttggaaaaggattaagaagccaggttggtactatgtatggtaccctgaaaaaaggccctcgttatctggaaatggcagaaggctatgtaacaggcatcgctcttgatgctgaagatcagattatcggctaccagttcgtaagccttggaaaaatgacagactttatcaagaagggcgacgatcccaacacagcctatgaaaaagcaaaaggtcagtacggccgtgttgctgatgctgttaagatcattgatccgagaaaagaataagaggaggtagcgaaaaatggctttatttgaatcatatgaaagacgtattgataaaatcaatgccgtattgaacagctacggcatcgcttcccttgaagaagctgagaaaatcacaaaagatgctggacttgatgtatatgatcaggttaagaaaatccagcctatctgttttgaaaatgcttgctgggcttacattgtaggcgctgcaattgcaatcaagaaaggctgcagaagagcagctgatgctgcagctgcaatcggcgaaggccttcagtccttctgtatccccggttctgttgcagatacccgtaaggtaggacttggacatggtaaccttggaaagatgcttcttgaagaagataccgaatgcttctgcttccttgcaggacatgagtcttttgcagctgctgaaggcgctatcggtattgcagaaaaagcaaataaggttcgtcagaaacccttaagagttatcctgaacggtcttggaaaagatgctgctcagattatctccagaatcaacggatttacttttgtagaaaccgaatatgatccttataccaatacagttaaggaagtatatcgcaagtcttattcagaaggacttcgtgcaaaagttaactgctacggtgcaaacgatgtttgtgaaggtgttgctatcatgcataaggaaggtgtagatgtttccattaccggtaactccaccaatcctaccagattccagcatcccgttgcaggaacctataagaaagaatgtctggagcagggtaagaaatatttctccgttgcttccggcggtggtacaggccgtacacttcatcccgataacatggcggcaggtcctgcttcctatggtatgacagatactatgggccgtatgcattccgatgcacagttcgcaggttcttcttccgttccggctcatgttgaaatgatgggtctgattggtgctggcaataacccgatggtcggcatgactgttgctgttgctgttagtatcgaagaagcggctaaagaaggaaagttctaaggtaagctatatttatagagtgatttgtagaccgcactaacctttgatggttggtgcggtttttcaattgtccaagaaacttttggatattaatgtttcgaagacagaaaggagaatattcgtcggtgacgttttctcttcatgaaataaccgcttgacaagtgtcctgaatcagactatactacaaaaaagaatccgaactcggacactgcctgtcagggaattttaatatggaaaagagtttggtgccgccgctgcatgaacattaatggctcagagaaacaagcggttgaaaaattttcatcacaggagtaacatttctgtcctgcactacttgtaaaaaatattacttttttgatggaggaactctgaaaatggctgacaaagagaatagtaaaaatcgaattataaccatccctaatctactttctttttttcgtatttgtttgatcccgctcattgtgtggctttactgtaagaaacaggcatatttctggacgggagcaattctgattttatcaggtctgactgaccttgtagatggctatattgcaagaacatttaacgcagtcagtgatttggggaaaattctggatcccgtggcggataagctgacccaggcggtcatgctattgtgtttactaactcggttcccttttatgctattccctcttgttcttttgattttgaaagaactgtttatggccattaccggtctatggataatccgaaatctgcaagccttgaaaagagataatgatatatgaaaacgaaaaaaatgctccggtgctcagtcaacataaggtgctgaaggggattatcggcggcttacagtaacaggcacatcattgctgctggtttgctatgatttatataagactaatacctatttttgcagagaggcgtttgcacaatgtcaattgataaaataaatttgcttgtttcttttgatgaaaactatatccttccattttggacaatgataaagtctgtttctgttaataaccccggggaatattttcgagtatttttgctgcacagtgctatcccacaggaaaaattggattggctgattgacggatgcgttgctttgggagtacgattaaccccactggaggtagaccgtaaactttttcagaaagcacctgtttcagaacgctatccccaagagatgtattaccgtttactagctccgtatctgttgccggaggaagtgggaaaagttatctatcttgatccggatatcttggttattaaccgcctgcgtccgttgtggactttggatttgaaagactgtgcctttgccgccgcatcccatgtgggggttaccaacattatgaacgggatcaacagggtacgactggacaccgaacatgattattataattctggcgttatggtgatagacttaaaaaaagccctgccattggtgaatccggaagtcatttttgacagtgttcgggtgcacgcgtcagaactattactccccgatcaggacgtattcaattatctgtatggtgcgcagaccatgccgctggaggatgaaatttggaattatgatacaaggtgcttttcggactatttactccgaagcaaagggatttactcgatgggctgggtcattcaaaacacagtcattctccatttctgcgggaaaaagaaaccttggacagagaactatacaaggcaatttaatgctttgtataaacattacatgagattagcagctttggaggcaaatccatattggaaatagaataaattaatgtcagggagtgagcacgggagttttgttccggaaggggatttgagcgaacagtataatggggttattcgttccgcatggtatgccagagtcagaccatgggtatgtccaatttctttatcaatgttccatagagaggccgataaaccacatccggggctgttccccggatgtggtttatgcgtccagtgccgtaggcaaggttttaaatctccttaagcgctacaggcggcagcggagtgtaccgttctcaagtctgtgttctcatcagtccgcgttttcaaactggctcttatggagcgcggcgtagaaaccgttttgtgacattagctgggtgtgggaaccccgctccacaatatcaccgtcgcgcaccacaaggatcaaatcagcattttgtatagtagacaggcggtgggcgattacaaaactggtttttcccttcatcagccgggccatggccttttggatctgtacttcggtacgggtgtcaacactggaagtggcttcgtccaataccagaatggcggggtcggtcagcatggctcttgcgatggtcaaaagctgtttctgtccctgagagacaccggtgctctcaccggaaagtacggtgtcataaccattcgcaagagtgcgtatgaagtgatcgcattgagcggatttggcggcggccacaatttcttcccgtgtggcgttcattttaccataggcgatattttccgcgattgttccctcaaaaagccaggcatcctgaagtaccataccgatatgccggcgcatttctcctctaggcatgtgagtaatatcctgatcatcaattaaaatggaaccgctgttcagttcatagaaccgcatgagcaaattgacaagcgttgtcttaccgccgccggtaggaccgacgattgccaccatttcattgggttttacctccagattcaggtttttgatgagggtacgttccggagtgtagccaaagcacacatcacggaataaaacatgccccttagaaatagcgtcggcagaaccgcttttgcagggaacttcctcttctgcgtcgagtagggtgaacactctctcggcacccgcgatcgctgcctgcatcgaggtaattacataggaagcgccggttaccggctcagcaatttgattgacaaactgtaaaaatgcctgtactgagcccagggagatgacgcctcccagaaccataccgcctccgaacacagcagttgcaataaatccaagctgccctaagaaacggatagcaggataaatggcgtagtcagcaaattgtgctttacgctgcgctttgtactgccattcatttaaggcttccgcttctttaagcaagggttcctgttggttaaacagcttaacaatccggttaccggtgtatatttcttcaatcttgccggtcagcgcacccatggaagccatattttccccatatgctttttgggcgagaccggaaacatagacagtggccaccatgctcagtgtaagagaaatcactaccaccataaagagcttcggacttaacgccagcataacgattacagtgagaacgattgtaaaaacagaggatatgaactgcataaggcctacctgcatgacgtaagacactttttctaaatcattggtaatccggctcataatgtcaccagccttatgcgtatcaaagtaacgcaaaggcaggcggtttaatttggcactgacatccttacggagagagagcacgaattcttccccgatactggctgtaatatactgttggatgtaggttagaagactgcttatcaaaaagataacgctcataatgagcaaaggcaaaccgagggcctgcatagcagttcggaaaatccccactgaactgtcaaatatccggatcgcggctaccagccggtctatgccaagtcccattgccaagggcattgcggtaaatgcggcagaactgagcagtgtggctgcagcgacggcgagcagcttctttttctgctgtgccatgcgatgaaaaagccggcgaacggtttcttttgtattatggggaatatcttcgttttgagtggtggtttgggtattctttctaatttctttcatgatttatgcctctctttcattcatttgactttcagcaatggcacggtatacgctgcagttttttaaaagtatatcatgagtgccaattcccaccagacatcccttatccaataccaaaatctgatcagcatccagaatgctgctgatacgctgggcaatcacgagctttgcggaagtttttacattttggcgaagcgccgtacgcagagcagcatcggtttttacatccagggcggaaaaactatcgtcaaagaggaaaacatctgcttttttgaccaaagcgcgggctatggaaagccgctgacgctgaccgccggagaaattggttcctccctgagcaactggggagtttaagcctttggggagtcctttgacgaagttttccgcctgtgctatgcgcaaagctgtccaaagatctctgtccgcagcctgctcgtttcccatccttaggttatcggcgatggtgccgctgaaaagaaatgccttttggggtacacatccgattcgatcacgcagggactgctgggaaagagagcgtatatccgtaccgcctaaggtgatactgccctgctggatatcatggatacgcagcagcaaatctgcgatcgtgctcttcccggaaccagtactgccgattacagcagttgtctgtcccggcattattttaaaggaaagatcatggatgaccggttcctctgcgcccggataggaaaacgatacatggttgaacgcaactattgcgtcttcttgctgttttaatttctttcctggtgcaatatcgttgtctttaatagcaggttccatatcaagaacctcctgcagacgtcccaggcatgcaagggttttcggcagtgtagtgaatgcggatgcagccgaaataagatagcccatggtcatggttgtatattcaatcacggcggtaatctgccctaccgccatagtacccttcagggaaaacgcaccgcctaaaccgaggataacaagcatcacagcgcccattgcaagccagatcatgggagtggctacagcaaagagccgatttaaatgtatcatgttttctgcatagctttcataggctttgccggaacgatgttcctcataggcttcgttgccaaatgcccgaatgacccgtacaccggtaatggattcccgcactactttgttaatgaggtcaagccgtctttgaatgctgcgggagagtgcattggatttttttaaaaggacaacagaggccagcatcataagtactatggaggcaaactgaatcagcgcaatcatcgggctgatcatgaatgtcataatcatggaggccacaagaataagaggggctggagccactatctgcagcatcatacccagagtttgctgtaaatttgtaatatccgaggtagagcgggtaaggagagatgagacacccaattggtcaaattgatgaacggaaagctcttgtatttttttgaaaagttttgaacgcatttcccgtccaaaaagagcgcccaaatcgctggtgacccaactgctgaaaacagaaatcgccgaacctgccagggcaaccaacagcatttgtaacccaacacgggtgatcaccttcatatcaccctgcaggattccctgatcaactacattggcaatgagcgttggaataagcagtgttccgaccacagaacacagaagcaggagtacagacaggaataattttcctttgtggctttttaaaaagattttaaaatatttcatataaaagctcctttattttttttcataaattgtttttgttatgcagaatgtgttatgagggctttctggatatatttataatcctatccaggattgaaacaagtatgatttcggactttatgagattatagtacgaaatcatacttgaggcaatgataaaattctaaataatttataaacagaatattaaatcaaacaggaaataaaattaagtattgacttagtacggaatcggacttatgctttaaatgtgggatgtatgaaatcggacaggaggataattgtaatggaatattcggaaaaggatatggtattgaaattcaattcagtttatagagagttgaatgacctttatcatgatatagcattaaaactaggaatatcagatagtgcatttaccattttttacgcaattttcagaactggagatggctgtttgcaacgggatatctgtaagcagacttatacaaataagcaaacgatcaattcaaccattcagaggctgaaagatgatgggtatctttatttaatacaggggaaggggcgtgataagcatatttatctgacagaccgtggaaaggaatttatcagggataaaattggtcctatgattacagcagaggatgaggcgtttctgatgcttagcatagaagagcaaaaacaattctattctgttttttcaaaatatgttgaatctttccgcaaaaaagtagaagaattgtcatgatgaaggttggttaagatacttggtaatgtagagtaagacatatgataatatcaagtctaaaaaggacttatggtgaagggaggcggaaatgaaaaatagcgaaaaggaacaattcatgatactaaaacgtattgcaaaacagaagtatgaattataccattttatttctatacagcttagtatttctgatacagagttctgtatattatattatttttgttgctcagataaacttattacacaaaattatctgtctgagttgttccctattcctgaggaaaccattcattccgctatcgtcagtcttataaaaaagggatatgtttatctggaggataaaatggctgcatgcgagggaaaagggttacgcttaacggaagatggaacagccttttgccaaaataaaattgcgcctgttctaatcggagagaaaaacgcattttcacagctgacagaagaagaacgtaataacttaatttccctttcccaattacatcatttgtttttactaaaagaattcaatggtattttagataatataaggagcgatgcaaatgaaagaaaaatggctcatatgtccattctgtcagagtaagacgcggttgaaaatacttgaaaatacagtgcttgaaaattttccgctgttttgtccaaaatgcagacatgaagctatcattgatgtaaaacagtttactatttccattattaaagagccagacgcaaagacgcagagccgataactcacaaaatttgtggtctcggttctttttttattaaaatataagtgattaacaggagggatacagatgccttcagaaaaatttatgcggttgaagttttataagagaaatgcaatcttggaaggagcgtgcatggaacttgcagatgaatcatgtgttaatttgcggatcagcagactggtgatcaggatgaatatttccagatcagcattttattcgtactttcataacaaacgcgatcttctgtgctgcctgctatactatctgtatgataatgtactggctgattttttgaattgtctccaggcggaagcgggggattttcaggaggcatgcataagggcggtcaataagatgaaagaaaatgggaaatgggaactatatgcctctttatgccggcggttcacatatgaaaaggaatatcatgagatagctgtttatacagtaaaaaaatactatgaatcaggaaaagtcaaagagttcatcgaagcatgctatgagaggcttgctcctgagaaatatggttccttggaaccggataaacttgaatgtggaatgatgtttgtttcggatattgtattgtatgtgctgttgacatatgaggcggacagtatggatggggaatgggagggtttattatacaggctgcggactataggacagggactgcagcacatttcatcagatcccccaaattacagtgtatataaaaaataagaaaataagcggaaaggaaacctggccgcttgatgctgtcagccttgcttgacggtaagctattcggattgccggcattaacttttttagaacgatgagacagtacttgatacatggatgtgtgatgatataaatattttagggacaggagaatattaaaatgagtaaaacggctttggttctagcgggcggtggctcgagaggttcctatgaactgggggtttggcaggcacttcgggagttggatatagacatccatatcgtgaccggaacgtccatcggtgcaatcaatggcgccgtaattgcacaaggcgattacgatgctgcaatctggctgtggaataatattggaaacaacaaggtgattgatactcctgtcgatgaggatgtatctctggagcagaagatatgggctacctaccaatgttatctggttaatttcgttaaaaatggcgggaccgaggtgaattctttaaaggaaactcttgccttgtttcttgatgagcagaaggtgagggcatcttctgtagcctatggattggttacgattgaaatggattcccaaataccgcatgaactgtttattgaagatataccagaagggaaaatgctcgattatattctggcaagtgcctcaatttatccggccttcaagcctcataccattaataacgtgcgttatgtggatggtgcataccatgataatcttcctgtcaaaatggcatttgataagggggcaacagacattattgctgtggatttggatgcgttcggagtggtaaataaggatatgcttaaacatgcagaacacgctgtctatattaagagctattggaatctgggtcccacgctggtatttgatcatgtcaccatacagcgtaatatccggcttggatatttggatacactgaaagcttatggcgcatatgaaggatatgcgtatacatttctgccaggtttttgtgaaaaaaatatctcaaagttttcggattgtctgcctttagaagattttctgtgcagaagcggcgatggtgtgtttgatcagttgtttcataaaagcctgtataaaataattgaggaacgttgtggacagaaaaataatgattatgcagttgttctggcttgtgcggaattggcgggtgagatatttggattgaattgtacagtcatttatacttatgaagtgtggcagcagcggctgcgtcagagtgttgccgagacaccattgccaaacatctccaattccactgaagttaatttactggattcggtacttgaaagcgcccaaacaatagtcaacagacggtcacgcacaaaactggttgcagctatgattaaagagctgatacaaacagaatcaacaatatggccagccgccagtttaatcgtattacctgaaacatttttagccggactttttctggcagttacaggggtgctgtaaaaaccggtgaaattgtatacattataattgaataaccatattatcacaggtctgtgtatagagatttctgaatatcctatgcacagacctacgttaatacggacttttatttcatataggtacatttttcatgactcactttaagtcgaagtaagcaccagaggccaagaacagccagggttaagattatatagattgcggtaaactcagcaggaagttggtgatctgcaatccggtatgttgtccatacgatccaataggaaagcatgagcagtggaagggaattttttaacagagccattctcgcttctatacgccgtattttgtcctggcacaaaatttttccattcatccgatgccaatattccccattaccttccgaagctattactgtaagactttcgaaattgctgcagtccattttcacacgcttacataacttcaacagttcttctttttctctaatctcttcactaaacttcttttcctgtaaatctatcacattatggagtgttgtctcccccttttgtagcgcttgtatctggaaaaccggaacctcaagcaggcgcagaagcttaatcctttccagtgtttcaatattttgctgatcgtactcccggtagttgttctgtccatttcgcttcggctgcagaagtccttcctgttcatagtaacgaatatttgccttttttaatcctgtcattctttccgcttcttttatgttcatgtcttgaacctccttacttcataatataattatggaaacatattcacaaaatctttggtgtaagtatctcctgcctctattttgcaccttcaagcaactggaatgtcaaggagttattgtttttgcattcattttttattcgcaggcggaattaaaagactatgataacaatcaattatctataccaactaaaataaggaaacaggaaaaagtaatatattataattccaaatgtacatgaatcctgatactataaatgacgagagcctccgtataaaattctcgtgccacaggccccgcaggcaatacattttttcaggagtatgataccggaagaaaaagaaacaaatatcgtaaatactttgcgagtatgatatactgtctaaaaagaagtggccctgccatattaacggacaggcggagggggaaggccatggaacagttttatcatgaatcgttccggacaacaaaacagtttcctatgcagcttcgtctgcatcagggcgttattaattatgcggttctggaacactggcacaggagtatggaaattgactatctgattgactgtgaggtgcagttgatggttagcgggaaaaaaacgctggtgcagtcggaggaaatcatcctgataaacagcggagatattcatgccctgtggccggaaagaaaaatcggccgtacgcaggatgagctgtttggcgcgtccatttttatatcatatgagtttctgaaggaaatctgtccgcagtttgatgaggtctgttttgtgctggaaggaaatgaggaaaagaaggaagaactgaagcatgttttcgatgaaatgatcgggatttacagaaaggaacaggaggagttcacctatctgaaaatgatggggctgctctaccggatgctgtaccttctttttacatatttcaaacaggtgaagaatcaggcaatcataaaaagccagaaatatatggaacgaatacagaaggttatgaattatgtggaagagcattatcaggaaccggtgacactttgccaggttgccgctcatttcaatctttccatggaatatcttgcccgggattttaagaagcacacggggagtacattccgggaatatttggataaggtgcggttaaaccatgcatttgagctgctttacggcacagattattccatgctggaggttgcaatgatgagcggatttgcggatgtccgttcttttataaagagttttaagaaggaacacggcatgacgccgtatcagtttaaaaagagaaataaaacggggacaagtgacaggaatggggtgtcttttgcagattatccccacattatcctgcaggatgcacaaaaaaagaaggatatataaagatagccgggcgaaatgacgagaaatatgttgtttcgcctgtttttattaaaaatatcaacttatatatgtcaatagatgctattaattcggctaatttttgtaaagagaatgcatctgtgaacggatacaatgatttaatcagatacaggcctgtctgaagcgaaaaaaggagaggggataatagaaaaagaggactaagaaaataatgggtgggatccattcaaaaagaaaacaggaggataggtaagatgaagaaaaatagatggacagcgatattgatggcggttattttatgctttggcctggcgtttgcgggcaatggaaggttggagaatgtacaggctgaagagagtaaaacggttactttgtatctgaccagacatggaaaaaccatgctgaataatacaggtcgtatgcagggctggtgtgattcgcctctgacacaggacggcgccgcggtggcggagaaacttggacagggcctgaaaaaggcagggatcttttttgatgcggcttattccagcgacagcggcagggcgatagaaactgcggatcttgtgctcaggaattgcggtcaggaggcacttacgctgaaaaaagaaccaatgatccgtgaagtgtgctttggtatttatgaaggggcaacccctccggaagcatatggagccgcttcggaagcacttgggttttcaagtgtggaggatatgatgggagccgtttttggcggaaaaatatccatatacgatgcggtgacggcgatggcaaatacggatgaaacaggatcggcggaaacatggggagaagcacagcagcgagtggtggaaggcatcgtgaaaatcgcggaggaagcgagattaaacggacagaaaaatgttcttgtggtttcacacggaatggcaatatccgcatttttatcagcggttaatccggaaatcgtagtaggagagcttggaaacgcgtccattaccaagattgtttatgatggaaagacatttactgtggaaagtgtaaatgacatgagctatgtaaaggacacggaatgaactgatcggcaaaaaggtaaagagcggggacaggacagtcagctatttgccgggcagggataattgtggtggaacgggttgaagcggaacgggtgaaaaaagtatattgcggtccggccggagtatggtataatcagctcatgccattaaatggcttacaaagctgatttctgcatggaagtacgtggtcattagcttactataatactatacgaggtaaccggagatatgatttacaccagaaaggaacttcagaaccaattgaaaggaatgtccctgcgtcctactgacagcattctcatacattcatcaatgaaagctatgggaaatatagagggaggggcggataccgtactggatgctctgatggattatttttcacaggggcttcttctgcttcccacgcatacatgggcgcagatgggagaggagtaccgtgtttttgatcctgtgaaggaagatgcctgtgtggggattcttccgaatcttttccggaagaggcccggcgtatgccgttcccttcatcccacccacagcatggcggcttatggcgccggggcggaagaatacatagccggagaagaggagaacaatacaccgtgcactcccggcggatgctatgaccgtctgaaggatataaacggcagaattcttttggtgggggttacccatgcgcgtaatacgtttattcacggtgtggaagaggtgctgaacattcccaaccgtttgacggaaaaacctgtggaattctatacggtaatgccggacggaagccggaagaagatttttatgagaagacattataatgcagttcagccttatatttcagaggatttcgtaaagcttacgcaggccttttatgatacgggagcggccagacaggttctgtttggcaatgcagaatgtatattgtgcgatgcgaggggtatcttcgaggttaccagacatattcttgcacctgatccggaatgtattatcacaagccctgaaatcccggcatccagatggagtgattttaccggcgggccttattttcatgtgtgacaggccactatagaatgttaaaaatgccgtaaggtcatgaaatctgatgaccctacggcattctttttattttctcttatttagctgctgttacagagataatatggggattaacaccctcataccagtacagatagccttccatatcgataacatcgccgatctgcaggttcttgacagctgcgtatacatcggtggtattgtcgcaaagataagactctacaacgaaggaataggtctcgccattcagggaaacgctgaagtacaggtcgtcgccgtccgtaccggagccatcccagttgtacaggtaagcaacgtcatttccgctttcatcctggccggcggcttcaacagtcatgcctttgaaggcaacatactgattctggtagtcgatcagttcatcggttccgagcattgcggtaacatccttgacgggagcgaggtaggtatcaccttccacgatttcaaaggcagcatcagtgatttccacttcaccggaccattcagacttatatccggtaactttgattttggttccgggcaccagtttttcataatcctcttctgaacaggccatattgtacacgaagtaagcgccatcctgatcctgggtatacacggtggctttgtcttcccaccaggactgctttgcctgtacataggtttctacaacaacttcggaatccaactctgcagccatgtattcctcataattcaatacgccttcggacttggaagcttcttctgcagcagtggaagtctcttcggcagcctctgttgtggtttcttctgcggcttcgctggaagcttcggaaacagcttcaacagaactttctgctgcgggagcattctcagtcttggcgcagccggtcattccgagcgcaagagtgagtgccagggataaaacgattgcttttttcataacattctcctttttactgataagcatatgtgtcggtaaatgccggactgctctgtaaggcaggatgcctgtacaaagaatacggccgtccgctgtttcccaaacggacaaagccattatatacctgaaaataccaggaatcaacatttttattaagttttacctaattttttcattgcctgccggataatgtaggcaagaatcaatacccatgcgcctgcgagacaggacagcagggcgatggctgtaggcggcagcgggccgagatcggctttgcctgcagaggcggggctgctttcatttaagtggtagagggatgccacatcatcataaaggtcgtcgataaaagccgcgttgacctcttttttgcggcggacggccttggtgacctcttccacaagctggccggatgcgctgcgcagggaggcggaaccgttgaatacaggtgtgacaaaggtatcgtccacatgatccagcaggaggcgggaagccttgatcttcacgtcatagtgcagggcattgtcttcaccgcaccgggagaggtaatcctggtaagccggggaatcctgcgccttgcttgtcacgggaacatagccttccgtttcggaataagcgatctgtacttcattggtgagcaggtactgggtaaagagccaggaagccaggacctcctggggatccttcttattaaatacacagacggagggcccctgggagatcatccggggatgttccggatcaaactggggtatcatcatgacttcggtctcaaaatccacaaaagcctcttcgctgatatcggaaaggggcgcatttgttcccatccaggtagcaccggctgtggaatcaatggcaaaaatacactggccggcattcaggaagttggcaggataactggatattttgaaggtggagaaggccccgcttttggcatgctccgcgatggtgtacagaagctgtgtggtagtatcgttgaaaagctggatttccccgtttgccgatgcgtagccggcatccttttgcttaagcatctgaatcatcatgttgtccgttgatttgtaaataaatggtatcatgacagactgtccgttaatgagataattgccgtctgcatccttcgctgtggccgcttcggaaacctcccatataaagtcccaggtcagcgtatccggaagggtatatcccagtttttccacataggttttattaatatagcagctttccgtggaacgcatgaagggcagggcgtaaatctgtccgtttaaggagcattcctccaaaaactgttcaatgatttcatcctgccggggagagtcgaagagaagctcgctgccgcccaggccatatctgggatcggcaatcagttcatcaaggggaaccaccgtactgtttcctgtcagataggtggcgatatggtcggggtaggtgatgcatacgttgggcgtggtatccgtggcaatattggtgataacatcattataaatttttccgtaatccgtatacagacggagattaacagtgatgttcggatacagcgtctgaaaatctgtaattgcctttttataaatatccgtctgcgtcttgttcgtatcattttttgcccaaaaagtgatctcgtactgcctggaggtatcgagctgttcggggatggaaaaggatttttggcctcctttgccgtggcagccggtaagcgtcgacagggcaagcaggagaaaaagaagggttatgcctgtctttctgtgcattatactcatccctttgtacctcctctggacacgccttccatgatttttttgcggaataccaggaataagaggatcagcggaacggagatcaccactacggcggccatcatggccggaatgttctcgcgtccgaagccgttttcacggatttcctggatcccattggataccagatagaagcttggatcatcggtaaccagtctgggccacacataggaattccagcattcgatcatcttcaggatggtgatggtaacgagagtgggcttgcatatgggtatcatgaccttccagagatatttgaaatcggaggtgccgtccgccttggcggcacggtagagctcatccggcaccagctcgaagttctccttcagcaggtaaatgtagaatacggaggtgacggagggcagtatcaggccgagaaaggtatttcgcatatcaaggtttgtaaccgttgcatagttcgtgatgatgacaagctcattgggaatcatcatcagggaaagaagcagggtaaaggcgatattctttccgcggaacgaaagtcttgcaaacgcgtaggccgccagggtaatcacaacaagcataatcgctgtggttgccagggtgaaaatcagcgtattcagaagatatccggcaagcggcactgtggtgaaggcgtcggcataattctgcagggtgggtgagatcggccaaaatgcaggaacacgctccgcattataggaaccgtaactttttacggaggtgagcagcatccagtaaaagggaaacagaaccacaagagcccagaatatcagaaggatatagacaagcgtatgggtgattcgtctatgtcgtttttcggatttttcaatttgacggtaatccatggttactcccatctgcgcactttttatgcgcgtacaaaagccttttaaatatagtggacatgttttctgctgattaacaggttgatgcaggttatggtgagcacaatggcaaacagcaggatagcggccgctgatgcgtaggagggatagccgccgctgctgccgtagagcatatcatacacataaccgacgatggtattcatgcctgcggcattcagatccgtgccgaacagtgcgacggcatcgctgtaagccttaaaggcgccgatgaagcctgtgatcaccagatagaagagcatgggagagatcatcggaagagtgattcttgtaaaaatccgcagcttcgatgtcccgtccacctgtgctgcccggtaataattctgatttacggaggccagcgcgctggtgaggatcaggattttaaagggcattaccacccagatggtgtacaggcacaggacagtcatttttgcccagtaggggccgtcgatgaaatcaacagaagaaccgccgaaccagtggataaggagattcacaagcccgtcggagtaggcggttttcttgaaaagaaccatgaaaacaaggcctactgcaagggtattggtcacataaggcaggaaataaatagtctggaacaggtcacgcagcggcttgacggagcttaacgccacagatattaacagggccaggccggtggaaacaggaaccgtaatgagcaccaacagaaaggtgttcttcaccgcctgcagaaagtagggatcatgcagtacgtaggaatagttatagccgcctgtgccgaagctggtctgggatgcaaagttgtagccttcctcaaaggaataaataaatacgtcaatgagggggtatatcataaagacacccagaaagagaaaagccggaagcagatacagccaggctttcccgccgccggagaaagaattatcatttttcatatcaagcctcccggatgcgttcaccattattcttgtcaaagagaaataccttacccggtttcagtgcaaagcgtactgtttccgaagcggtatttactccgttatctgaacccgcaatggcgcgtatgagcgtattctcacagtcagggtgggtggaaacgatgctgatatcacgtcccatcacctccacaccgtttaaggaacagcttaaaggcccgtcctcctgcagaaggaagccttcgggacgtacacctgcccatacctcctgatcgggtatgccggagacgggaagaaccgccgcttcaccgatagtaagcctgccgttttgtaccttcccatggaatatgttgatgggaggggtccccaggaattttgccacaaaaagatttaccggatcgtcatacacctcctggggctttcctatctgctggacaaccccctgcttcatgacaacgatctcgtcggaaatactcatggcttcctcctgatcgtgggtgacgaaaacagtggtgatctgcgttgctctctgaatcttgcggatctcctcccgtgtctgcagcctcagccgggcatccaggttggagagaggctcgtccagcaggagtacatgcggcatttttaccagggcacgggcgatggcgacgcgctgctgctgtccgcctgacagttcactgggttttctgtccatcaaatcctcgatctgaaccagaccggcggcctgggaagcccgctcaagcatttctgatttggagagcttctgctctcctttgaaattttccaaaggaaaaagaatattctgttttacactcagatgggggtagagggcataattctgaaacaccatgccgacccctctgtgctccgggggaagttttgtcacgtccctgtcaccgaagaagatctgcccttccgtgggtttttccaggccgcagattaagttgagtgtggtacttttgccgcagccggaggggccgagaaggccgattagcttgccgtccgggatctcataggtgaaatgatctacggcgatcacgtcaccctgggcttttttattgcggttcgggaatttttttgtcaggttttgtaattggattttcatacgtttcctcatttctgcatgatttaccaaaatgtattatagcagattctgccaggtttatcaccggattttttctaactatattatagctgacatatttatcctgtaaaggataatcgtaattaatatggaggtaagtaagaggaaaggcggagtattgcagaagatggtatcctccgttttgttttcggtatcatcggtctgtccgaccgccatagtatacctccctgtttatttcagtataaactgagacacggtgtcaaagttaagaaaaatagtcatgctgcgcagaaaaatggatatgaaataatagagggtgaatacagtcctggacaaaagctgataaaaccaattgcagtttgggtatatttattactggcgttctgtctgaaaatcgtctataatcagataaatatattagctgtaattaacttatctgtatctgtaaattattagtacaaaaataaggagaaacctatatgaatataatcaggccccccagttaactttcagataaaacaagaaatcgaggtcctccaaaactaaatcatagttacttgtaaacgtgataaaaaatggaggataaaaagtatgaaaacatttaatgtcaggttcttatatgtaagcaagtttataagccaatgcctgccaatatatgcgttctacacgattttgtttattaacagaggaatgtcggttcccgacatagctgtcttaatggctctctggagtatatttaccattatatttgaagtgccgtcaggtgttctggcagaccgatggaacagaagaaatatgcttgccattgcagcagttttacagggcttatgtttccttatatggttcatttcacatacatttttaatgtttgttttaggttttgtcttttgggctgtcgcaggagcatttacttccgggacagaagaggggttaatctatgataacctgaagtgtgacggacgtgaaaacagttttgccgaagtatatggaaaagccagattttatgcagatgcggggatagctgccggaattgtaacggcgggcgttattgtcagttttgtcagcattgaaattattgcgctcatatctgcggcagtatgttttgtcaatgtaatatttattctgcagttaagagagaagaactattattcagagcggttaaaggaagaatcagtaggatttttcgggacatttaaagatgctgctgttttaataaaggggagcggcgctgctctggtttcccttttgtttttgatactctttgcctgtcttggtgactatctggatgaatatgatgctctcattattaatgaccttcagctcagccatatctgggtcagtgttattttgacaataaggtttatattcgttgctttaggcgatattctggcatcggtcatactaaagaaggttttttcagtcagacaaatatttcttctttatggagcggcatgcatttttcttctgattttcactatattgtggaatcgatgtgggttcataatcttcggcatggctttagctggaatggtaatagccgagattttgtcagtaaatattctgcagaatataattaaggaagaaggccgcgctacagtaatgtcgttttatggtgtcggacagaatgtggtgatgatctgtttcagtctggtctatgcatcgctggccgggatatttaccctgcagcaggtgtactttataatatcggtttatggaattgcaggaagccttgttttttgtctgatttctgtaataatgaaaaacaaagatgaaaagtatccgagataatactttttttaagtcgggacgataaaatgataacgaatgaatatattaatcgtgcaatagactatattttaaaccatatcgatgaagagataacagtggaagatatttcaaattattgctgcttctccagatattatttctccagaatatttaagatggaaacaggcgaaagtatttatgaatttatcaaacgggtaaggatggagcgaagcgcattccgcctgaaggttgaaaaagacagaagcattacggatatcggcagtgcgtatggctacagctcgtccaactatagttctgcgtttaagaagcatcataatatgccgccttataaattccggcgcagtattgtgcacaaatcgatgatgaatccggttttcagaaacacacagacagagcttttgacatggcaggaatgcagtgaaaaaatttctgttgaaatgtttgaggactgtacggttatctttgaaagatataaaggaagttatggcgatttgtccgttcactggggggattttctggataaatataaggagtatattacggaacagacaagaattctggaacgttcctatgacgatccggcaattacactccctgacaaatgtctttgcgatatctgtatcgatgctccgacaggatgcacccttgaaaatatctgtacgataaagggcggcaggtttgcggtttatcatttcagcggccctgtagagcatatatacagcgcctaccagaatcttttcagtgtctggcttcctcagagcaaatataagattgacgacagctatggctttgaaatctataaaaaaacggactgcggttccatgcatatggatatagatatctgcatcccggtcaaatagagcacaaaatcagaagtttgaaaaaatgatctccgttattctatagaaaaacaaagaataaacggaggaaaacaaaatgaacctggaaaacatccaaaggaacaaagtaaaaacaattctgcagttttcaatcccatcaattattgcaatggtgctgacatcgctgattacaatagttgatggattttttatcggaaactatgtgggaaaagaagggcttgcggcagtgaatctggggctgccgatcgtgtatttatatctggcattgggacttatgatttcggtgggaggagtggtaattgccggaatggcattggggagcggtgataaccgtacctgcaacagtgtgttcaatcagacgatgtttacggtaatcgtgttaacggtactgctcagtattgttgtgtggttctgtcttaaccccatgctgcgggtgctgcatgcggacggagatgtggcagtattttttaaggattattatggcattatgctggtacagcttcctgttatggtaattaattcatcctatgggatgttcatccgcggagaaggaaagcctcaatattttatgcaggtcaatattttaaatgtgctgctcaatattttccttgattatttatttgtacgctggttcggatggggagtaaaagggattgcgctggcttcgttattggcaggtgctgtcactctggtgtgcattctttacttctttcttaaaaaatcgagtgtttataagctcggacggtttgcattttcacgtatggtatgtaaggataccttattaaacggcagttctgaatttataggtgaaatatcattgagtatttcaatgtttgcatataactttgtgattttaagaaatatcggaatagagggtgtgaccgccttcactatcgtagggtatattgcttttatattcagtatggtgaccatcggtttcgggcagggagcaagttctcttatcagctttacttatggagcaggagaacgggggctcacaaaagaactgcggaggataaccaatataatggtgctggcggcaggagcggcggttatgctgtttgtattgggcggttccgaatggtacggcagtctgtttgtgaaaaatgatacggttgtgcagatggtgcgttcgggagcgggtatttatgcattctcctttttattttcaggaataaatgtgattaattccttttatttcacttcgattggcagggccatggaatcggccgtaatatcttcatcacggggcctggtactgttattgatatttatttttatcctgccgccgtttcttgggatgacgggggtatggctggtggctccgttaacggaagtactgacattatttttgggcctgttttttatcaggaaagccgattcaggggcctgaagctgcggtttggtgttctgttttttgatagcttctggaacaaaagattgacaagattcagagatggttttatattaaaaaaagaaaaaggaagaaatcaacattattttaatcgacctcatgccgatatataggaagataattttttatagaggcaggtaaagataatgagtgtttatatcaatccgattgcaaatggaattacggtttctttgatgataatctacctggcatttattccggttctgatttatcaatatcgaaaaaatggtacttttcttgtacggaaaaatattgtactggcatcttttgcagtatatatgataacagcattttttatgacgctgttgcccttaccgtcaattgaggctgtaaaaaatatggctcccgtcagggcaaattatcatccgtttctgtttgttaagaccttcctgaatgaatccggatttatctggaatgagatggggacatggttcagagccttctgcagtccgagtttttatacggttgctttcaatgtgcttctgacactgcccttcggggtttatttaagaaaatattttaataaaggcctgtttcaaacagcggttttaggctttttactcagctttttttatgaagcgacacaatataccggggtatggtggatttatccccatgctttcaggtatcctgacgtggatgatcttatcgtcaatacgctgggtaccgttgttggattttatgccgcagggttgctggacaagctgcttccggatccgatgaaagataaatccttaaagacagaatatgccagcttgttaaggcggctgatttccctgctcatcgattccatatttgtaaatatcgtgtatgaattgctgagagttgttgttctcctggcggcagggaagaaagaaaatacaattgatattgttttatatctcatttcagtggtgattatttttattctgattccctgcatatcaaagaagaagcggacttttggcatgacgatattaaaactggcgttaagagacggaaagggaaatgttccgcggctgtcagggatgattatgcataacctgtttattgctttctggcttaatgtggccgtaaatataatcggtatgattgataatgcgtggattatcatatttttacagttagcggtactgggcttcgctgcggcattgttgatcataagcataaaaaataaaagggttacttatttttgggagaagttctttgatacttatatgaaagcggatatataaaaatctgacagatacggccgttcccaatagcggaatggatattgacatacagtgaaccgtgtaccgggaactcattcacagaatagaaaagggaggaacaaaaaatggtaaatgttaaaggcaaatgggcgttagttaccgggtcaagcagaggggttggccgtcagatagccttgtttatggcaaaggaaggatgcaatttgatactgcacagccgttctcttgcacataccgggaagcttcttgaagaagtaacggcaatgggggtagaggcttatgctgtagaggcggagctgtctgatcccgcggcggtaaaccgtatgctggatgaaatagaagaaaaggggacgccggttgatatcgtatttaatgatgcgggagtacaaattgcatatcgtgacaattactgggagacaccggttgaagattttacccagagctttatgatcaatacaattgctccggctattatctgttaccggttgattcctaaaatgatcgaacgcggtttcggacgggtgatcaataccaccagcggtatccggaatgaaccccagcaggcaggctattcggcaagcaaagcggcgctcgataagtttacgacggatctcgcgtcggcgctgcccgaggcggatgtaatgatgaatctgacggatccgggctggctgcgcactgatttgggtgggccgaatgcaccgggagctgtggagagctgtgttccgggcattgttgtcggcgcatttctggatgacggcaagagcggacggctcctgcccgcgcaggcatttacgggtatgacgctggaagatgccgttaagaaggcacgtgagatgtgaaaatgtcttttttcttaagataggtaagggcctgtgcgacaagcacaggtccttttttcagagcagtatacttttccgcaataaaaacaaggattttcttttgccaggtcttaagtatgttttcagttaatatactataaaaatgaaataatggagaaatctgtgcatgaacaaaatcctggatgaaaattatcttgatttaataattgataacacgttgttgggagaacaggtacaggaaagtgatattaccaggctcaataatatgtattcaatccttcatgtattaagggaagatcccacgccttgtgagcttggtcagctttatgaatattatagctttccaagcctgtatacgccgatggctcaggcagggatagatgatgcaggcgtgagcagtgtccagaataacccttatttggcgctctacggacaagggatactggtcggggtaatagataccggaattgactaccggcatccggcttttttggataaggatggaaatacccgtattgtcagtatttgggatcagtccatacaggacggaacgcctccggccggatttcaatacggtacagaatatggaaaagacattatcaacagggcgctccgggctgaaaatccgttggacatcgtaccgactgcagatacaaacggacatggaacagctattgccagtattatagcaggaagcctgaatgaagataatggggtcagaggcatcgttacacaggcggaactggtagtggtaaaactgaaaaagccaaaaaagaatctgctccaaatatcttttgtgccggaggatgcggagtgctaccaggaaacagatattatgctggcattgaaatatctggagggggtatcccgaagtctcaggcgccctatggccatttgtttcgcactcggaagcagtcagggtagccatagtgaattcagtaccttaaacgactatatggacagaatcgtattactgcctcagatagatattgctgttgcggcgggaaatgaaggaaacagacggcggcattatttcggtgcggcggaagccgctccatacagccacagctttgagctgaaggtcggagagaatgaaaagctgtttgcaatggagatatggtctgggctgccggccaggctgtccattaagatcatgtgccctaccggtgaatatacaagagtcatttatccgcagctggaaagctgtaatgcttttaattttattttcgaagaaagcaagatctgggtaaacaatattacattggaaaaagaaaatggagagcagctgattttaatcagattcgaagaccctcatgaaggaatctggacgtttgatttggaaaatctggaagaggaagcgtatacttttcatgcatggcttccgtcaggagatctgataacggatgaaacttattttttgaaaccgtcgccctatactacagtcaccatgccgggaacggccaataatttgctgacggtgaccgcatatgatcctcagacaaagagtatgcttgcccagtccggctgggggtatacaagagactggagagttatcccggatgtgacggcgccgggaaatatgattgcatgtgccatgcccaatggcctttacggtaatctgacaggaaccggagcggcaacagcatttacgaccggagtaatagccatgctgtttgaatgggcggtggtgagaggaaactatacttcagtaaccggaagcgatgtaaaccagctgattattcgtggggcggacagaagcaacgcaagctatgtttttcccaatcccaattggggatatggaatcctggatatttatggaatcctgagtaaattaaatttgtaaaaggggctcctgggataactcaggagctttcgttttccatggattcctattgtcattgccggcttaaaatggtatgctgaaggcataagtaataaacggataaatgaagagttttcctgctaatattaaccacagaacagaaggtgttttatgaaaaattatacaatagcagagcagtttgcggtaatcgcgcttaatgcccaggacagtctgcatgaaagcgtggcaaagaatgtggcactagtaggaattgcggcagcaaagacggtgcagacccttttatatgaggagaatagggatgccgcagtatttgagctaaaactgcgggaacagcttgacggcattaaaaaaatgaagcgcaaagagcggaacgcactggagaaggaattcactgatatattaaaggcggaaagaattctgaaggagattcccaatttattaggctgtgatatgaactactatacagccaacgtgactatgagagaatataaaagtgattctgcactctatcaatccataataaagaaaatcaggacgtgtgccctggaacagaccgaattgccggaagatattgtaatattactttggctgttcagggaaagcggctgtatgcatgatattttttcccaggaggaacaggagaaggttcggattaagctggtacaggctgcagaggaaaagtctctgtataaagccattctggaacaggagtttcacagcgcggtatggcttttggggctgaagtttatgaactggaagcataagatttttacaaatccttatctggaaggcgttaatctgatgtttccgtttctggacaggcgtcaggcaatttttattgatatggtgattatgggtacgagcgtaaaggatagaagaagtgctgcaattgcttttttagagaaaaacggacatacttgtgagaaaataaaaaatgggacggagacaatagtaaaagtggataatgaatattaccgcattttcccgtccacccgttcctttaaaatccctatccagggtgtggagcttttgccggtgtataaatgagaaagagaaaggtgtgcctcttgtggcgcacctttttatgatctctgtctatgggccggtatcgccggccttatgtcacttatcctcatggtaccaggaatgagaggatgtatttccttatcccaattataatataaactgcatcagaagtgattggcgaaatatccgttacaaaacgcaaatgtccggaattggaaggggaaagcatcggaaacccctgtgccgaggattgtttaagacggatatgaatggcgatccttgataaggtatgataaaaagtgtaataggcaggaggacaaagttatggatttaccttttcggattgagaaaaaggaaagctttcgggtaataggttacatgattcagacaacaaataaaaagggtgagggaagaaaggctgtcccctcacattgggccaggtttaaggcagaaggcctggaaaagccactgctggaattgacggaacaggaaccgcaggggctgtttggcattaatatttataatacggacgaagcggatccccgaaaattcgagtatctgattgcagctgcaggcagcagtgatgcacagggtgaattcacagcttacaccgtaccggctatgacatgggcggtattcccctgcacgattgaagccatagggaaaacggaagcgcaggcaatcacaaaatggctgccaaaatcgaaatacagagcgttgaataagggttatctgatgggtaaaatgaaatcgggagcgccggatattgaatactatggaaaagacgggtatgctgaagtatggattgcggtaaaggaaaaatgaggaatttcctgtaatccatcaattctggcactaatataaaaataactccacaagactgcatttgtgctgtataataatcaaatagttttacatatcttatttgtgatacagaaaaaaggacagatggacaaatggtctttggactattacctatgatggatacagggaaatcagactgatttctcatatgataaggagaacatcaatggcttttttaccaacagaggatctatacgacaatgaaatttatctcaggcttgaccggacagcggaagaaaataaggaaaaaggatatgtaccggcctattattttacgatatgcctgagggataacagtcaggaaatcggcagctgtgacttgcggataggctataatgacaacacttattacggcggaaatataggttaccggattgaagagccataccgcggaaatcactatgcggccaaggcgtgccgcctgctttttaagctggccggagaacatgggatgaaaagtctgattataacctgtgaccccacaaatatagcatcagccaggacttgtgaatgtgcagggggtattctgaaggaaattgcacaattgccggaaacgaatgaaatgtacagggatggagccagagaaaagtgtatttatcaatttatgacagataattctgataaaagctgaaggtaatttattttccggttatttataagaaatagaaaaaagaaaaaggaataaactatgaatttctactttgctcccatggaagggatcacgggctacatatacagacgcgcctatcacagctgtttttatcccatggataaatattttactccctttatagcccctaaacaggataaaaccctgaattccaaagaaaaaaatgatattctgccggagcataatgagggaatgcgtgtggttccccagatcctgaccaacagagcggaggatttcattcgtacggcagaaaagctccgtgagttcggctaccaggaagtaaatctgaatctgggctgtccctcggcaacagtggtatctaagaaaaaaggctcgggatttctgggagaacgggaagccctggatcggtttctggagaacctgttcgaaaatctgagtatggatatttccattaaaaccaggctgggtatggacgagccggaggagttttaccggctgctggaaatctttaacaaatatcccctgaaggaactgattatacatccccgtgtgcaggctgattattacagaaacagccctgatcggaaggttttcgcagatgcgctgaagataagccggaacagcgtggtatataacggagatattttttccgaaggtgattatgaacagtttacagcatccttcccggagaccggagctgtgatgctggggagaggcatactggcaaaccccggactgcccggaagactgtgcgggaaaaagcagccgtcaaagcaggagataaaacaatttctggacaggcttgtacaggactacagggaagtgctttccggagaaagagatgtccttttcagaatgaaggagctttggttttatctgggctttttgtttaccaatcctgaaaaatatgtaaaaaagattaagaaagcacagcgcctgtgcgattatgaggaagctgtcagaactcttttccgggaacaggaactggcagaaaacggcgcattccgtccatccgtataaaaagatcagctgtcataaggaccgggcagatatatcccacaaggatatgtctgcccggcccttatgaaatgctgacagtatggaaagcgtaaatgcggaaagtacaaatgcggaaagtacaaatgcggcttgctttccctatggtaaaatgttataataataaagctttgctgctttaaagcgtgtacgcggcagcgtgtgtatgccggaagccgaaaatccatgcatgcaatacccaagataaaatatccaaaggagacggaatgatgggggaaaacacagttattgtaacaatctgcgtggtatattttctggttatgatcgggaccggaatctatgcatcgagaaagaataagaaagcgtcagatttccttgtggcaggaagacgactgaacactccgatgacagccataacactggcggctgtccagataggagtcggcattgtgctcagcagtgccacaaacggttataacgatggcgtatggccgggaatttattattccattggctgcggcggcggattaatcctggccgggcttctgaccgcgagaaagctgcgccaggaggaaggctatgtgcctctcgatttcttcgcaaagagatatggggacagcaaaggcatccgcttctgggcgtggatcagcaatgtaccgagccttctgggaattttcatcgcccagcttcttgcctgcggcggtatcctttccggctttgggattccttttgaagcaggtgttgtcattaccgccgtggttatccttatttactgtacggttggcggcatgtggggtgttgtgcttaccgatgtaattcagacaggaattataatcatcgggattcccattctggccgttgcaaccctgattcagtatactcatgcgggaggaagcatcggagctatctatgcaacaccgtttattcctcatggaatgggcaccaagtttatttatctggtgctgccgtttttcctctccatatcggtttcttatgatgcctatgccaggattcagtcggccaaggatgcgaagacggctaccaggggatgtattgggggcggtgtgatcgttattattatcggtctgctgtgttctacggtgggagctgcttccaccatgcttttcccgggagtgacggacggtatttttaccatagcggctaccggcgttcttcatcctgtgttggcgggaattgttattgcggctattctttctgcggcgatgtcaagcgcaaactgtgttattctgtctttgggggcttctttttccagggatttctataacaaatttcttcaccctgaggtggaaaatctggatgagcttcccaaggccaagctgatatcccgtgtggccgtattcggaggcagtattgcaggaattctgtttgcctttaagatgacggatatactggacgccatgattatttttaattatccgtatatgggaagtatgctggttcctctgctgggagggcttttgtggagcggtgctaccagaaaaggcgcctttgcggctgctttcgcaggcgggatcgtaggagtggtttccttctttatcggaatcccgggacctctttatggtgtgatcaatgtggatctggcgctgatgatcgcttatctggtatcagccgcagcgctggttattttcagcagcctggataaaaacgggaagaaagtgcgtgcttaaccggcagcataacaggaaaatgtaaaaggaatgtgagaagatatatgagtacatatcagtggccatatcaaaatgaaatcggtcaggaagaggaagcttcctgcgatgtcctggttttgggcggagggcttgcgggatgctatgcggccatcgccgccgccagaaaagggaagaaggtaatcgtggtggaaaaaggggcaaccgagcgcagcggcgcggcgggaagcggctttgaccactgggaatcggcctgtaccaatccctgttcccttgtcacggcgaaggagatcgccgaagcatatgtggaggagcaggattattacagcaatggaatagcccattatatcgaatgcagagaaggctatgaccgccttctggatatggaatccttcggcggaaaggtgagggatacggaagacgaattcaagggagcggagttccgggatgaggaaaccaggctcatgtttgcctatgattataaaaaccgttttaccctgcgcgtatgggggagcaccttcaaaccggccctttttcaggaattgaagagactgggggtaaaggtttatgacaggacagaggccactgcactgctgacgaagacagagaatgggaaaaaacggggaatcggtgccatgggcatgaatgtgcgcaccggaaaattcatggttttcaaagcaaaagccacgattcttacgatgtcaagaccggccaggctctggctctttaatccggatctggtgggactgtgcgagttcaggccgacgcagagcatcggcagcggacatgccatgggttatcgtgccgggattgaattcaccatgatggaaaaatccgtgaaaggagagttttctgcggcgggcagaagcttccctccctatggaacaggcaacaatcataatacctggtatgcggcaaccatggtggatgccaggggagtggaaatcccctatgtggacagggacggcagggagcttcagacggtatcggagcgctattatcctgctccgggacagaagtttttcctgaagggcggtgtgatcgacgaggccaaatatgaataccgggggccggaaacccttccttttgaggaattgataaaacggggctatcagcttcccttctatgcggatttaagccgtatgccggaaatggaacggaaggtgatatggggaatgatggtaggagaagaaggaaaaaccaaaattcccatcctggaaaattatacgaagcgcggatttgatccggcaaagcatatgctgcagagctatggaaacggctggcagtccgctgcgttccttgcccaggagcgccagcttttcggagcgccgggcggcattatgcacgactgggatctgaaaaccaatattgatggtatttacgccgcaggtgatcagctttttgcatcggactgctgcggatttgccgcggcaacagggtactatgcgggaagaaaagccgcggacagtacggagggcataccggaagcggaaccggaccggctggagacagaagcggagaaaaaacggctctatgcccctctttatgtagaagagggaatggattggagagaactgaatatggccgtctccaaggcgatgcagaactactgcggcggcgtgaaatgcaaagcgctcctggaggaaggtcttgcgctgcttaacagctatgaaaaagaagcgctgcctcttgtgaaagcggaaaatcctcatgaactcatgcgcgcccatgaagtatttgatattctggaggttgccaaaatgattcttcaggcttgtatcttccgggaatccagctccaggcccctgtgttttgaacgcagtgatttcccggaaatggatccgaaggaagataattgttttatcaccatccgccaggaaaacgggaaggcagttaaaggcagagtccccctgggctatttcggtgatttggaaacggaatatgaaaaaagaaatcaggattatataaagagccgctgatacggctgcaggggagtgtcaggcaccccttgcattcattcgcgtgcagatgcgcgcagacaggaggaaccatggaaaaggaaatgacggcttcggtgattccctgcagtgcaaggccgctgaaattcgatgacagtctgtgtgtgggctgtaaccgctgtgcagatgtgtgccaggtggatatcatgatacccaatcccacaaaggggaaacatcccattgtaatttatccgggagaatgctattattgtggcagctgtgtgatggcctgtccgaataaaggggcgatttccctggaacatccgcttatgaaccaggcgaaatttgttccggtcaggtgatagccgctgaacacttgttttgagtattcggcccttacggcagcagaacagggggcatggtatgcagaaagaagattgcggaaggatggcgggctttttcccattctgggataagctgaccggagaagaacagaagacaatctgcaggaatgctgcttcggcagagtatccgaaaggggcttttatccatcgggcatcggaggactgtgtgggagtccttctcgttaaggatgggcagcttcgggtatatatgcagtcggaggacggcagggatatcaccctgttccggattgatgaaggagaagcctgtgttttaagcgcttcctgctttatgcaggaaatcacctttgagatcctcatagatgcggagaaagacagcgaggttctggtaatcccgacggctgtcatccgaaggctttcccaggaaaatatctatgtggagaattttatctacaaacaggcggcggaacggttttccgacgtaatgtggaccatgcagcagattctttttatgagcttcgataagaggctggcggtgttccttgtggatgaagccgccaaaacaggagaagataccctgactatgacacatgaccagattgccaggtataccggcagcgcaagagaagtcgtttcccgtatgctgaaatattttgaaaaagaaaatctggtggaactggcaagaggcagagtgaagctggcaaataagaaaaaactgcaggaactggcccggaaatagcagtcagtaaaaaaaagaagacccgaaatcagacatatgtgacctggttacggaaaaaaagcactccccggagtaagattgtttcaggatcttatttcgaaggagtgtatttttatgagtaaaacagtgattatcggcggcgtggccggtggggctaccgcagcggcaagacttcgccgcagagatgaaagcatggaaatcgtgatgctggagaaaggagaatatatttcctttgccaattgcggccttccctattatatcggggacgtcattcacagccgggagtccctgctgctgcagacgccggaggggatgaagaaaaaattcaatatagatgtacgtatctgccaggaggctgcagccgtccgtccggaggaaaatatagttacggtacgtaatctgaagacaggagaaacctatgaggagaactatgacaatcttatcatcgccacaggttcctcacctcttaagccgggaattccgggaattgacggaaaccgcatttttaccatctggaatattgcggatacggacaggatcaaagcatttatggaaaaagagaagccggagagcgctgcagtcatcggcggcggcttcatcggcctggaaatggcggaaaatctccatcgtgcgggtctttccttatccgtgatagagatgcagaagcaggtcatggctcctctggactatgaaatggcccagctgctgcatgaaaatatggaaatgaacggcgtggagctgattctggaagacggcgtaaagcagttttgtcagaaggaaaaccaggtggagcttttgcttgccagcgggaaaacaatccgcacggatatggttatcctttccataggggtgcgtcccaacagccgtctggcctcagaggccgggcttgccctgaatgcaaggggcggtattctggtcaatgaattcctgcagactagtgttcccaatatctatgctgccggggatgtcattgaagtggaacagcttgtctcaggagagcggacaatgatacctctggccggccctgccaataagcaggccagaatttgtgcggataatattgcgggcgacaggaagcgctatgaaggaagcctgggaaccagtgcggcccaatgttttgatctgaccgccgcggctgtgggcttaaatgaaaaggcgctgttggcctccggaaaaataaaagaccgggattatcataccatactgatacagcagaaatcccatgcaggctattatcccggcgcgtatcctctgactctgaagctgctttttgatccggattcccggatcctgggtgcacagatagtgggccaggagggtgtggacaagaggattgacaccatcgcctccgtcatgcggctgtccggcacaaccgatgatttggctaaactggagctggcatatgcccctcctttttcctcggcgaaggatccggtgaatatggcgggctttacggcggaaaatgtgcagaaggggcttgtatcctttcttggagtacaggaactggaaagcatacaggcggatgaaaagaagagggacgactgtcagatactggatgtgactgaggcggcggaacgccttgtatttgctgtccccggttccgtgcacatccctttgggagaactcagggagcggatggaagaactggatcccggaaaactgattatcccttactgctcggtgggagtccgttcctataatgcggcacgtatcctgatgcagtccggttttaagcgggtgaaggtactggaaggcgggacgacattctataagtcctatcattataaaaattacaggatggcagaagctatggaaaaaacgatgcgggaacgaaacgataaacaggaaaaaagagtgctggaactggactgcagcggcctgcagtgccccgggccgatcatgaaggttaatgagactctgcgcgatatggaggaaggagaaaggctctgtgttgccgccacggatttgggcttcgcacgtgatatttccgcatggtgttccagaaccggcaataccctggctgcatcggaaaaggacggaaaacagatccgggttaccattgaaaaagggaacggagaaaaaggaagcgggaaagcagccgaaacaggctgttctgtccgggaagacagaaatcctccggcggaacgggaaggaaaaacaattattgtatttgacggtgacctggataaggtgcttgcagccttcattattgccaacggagcggcagccatggggaggccggtaactatgttttttaccttctggggactgaatgccctccgcagaccggataaagtaaaagtgaaaaagccgttcctggatcgtatgttcggcatgatgatgccgcggggaacagggaaactgaagctttccaacatgaatatgggaggcatgggcacacggcttatgaaaaaggtgatgcgggataagaacgtcagctccctggaagagctgatgaaacaggccatggcacagggagtgcgcctggtagcctgcaccatgtccatggatgtgatgggaattaccagggaagaactgatagatggcgtggaattggcgggagtggcttcctatctgggggatgcggagctttccaatgtgaatctgttcgtataataagaccggccggaagaggctctgcggaaattttctgcaggacctctttttatatgcatggcggccgttttgccctgtcatttctgcgtcggcttaatggaaaccatatgttcggaaaaaattgtttggaatatgacagggaaaaggatataataggggaaataagaaaaaccggccgggccggagaaggcggtaaagaaagttgaaccagctgcgaaagatattgaatgacacctttaatctgaacacggactgtgcatcccaggaggagattgcggaaaggataaggagcggagggcagcttcggggaaccaacatgtgcatcatgattcttgccatgtttatcgcgtccatcgggcttaatatgaacagcaccgcggtcattataggtgcaatgctgatatctcccctgatgggcgggatcatgaatatcgcttatggaattgcggtctatgatatggcccatgtcaggcatgcgtttatgaagctgggatttcaggtggtattctgtgtgctggtatccacggtttattttatgctttccccaataacagccccgtccaatgagctgctggcaagaacctcgccgacgatttgggatgtgcttatcgccgtgttcggcggccttgcgggtatcataggcataacaagggaagaaaaggtaagcaatgtgatcccgggtgtggcgatagccacggccctgatgccgccgttatgtacggctggctatggaattgcccgtcattcctggaaatttttcggcggtgccatgtatttattttttatcaactgctttttcatcggcatggctgccgttgtagttctgaaaatcatgcatgtgacctccaagagggaaatttccgataaagtactgcggaaacagaagttctatgtgtcgcttgtaattattattaccatacttcccagcttttttctggcctggcagatgattaacaacagcgcggtgaacagccagttcggcagctttatttccagccagttcgattttgatgatacgcaggtggtatccaaaagcctggatgccaaaaacgggattatacgggtggctgtcgtgggaaagcgtctggacagctccacacaggaggctattcaggcggcgctttcggaatacagccatctgaagggcatgaagctgtatctgacccagacggagtttaccggaggaatttccaaggaagaggtggaaagcctgataaatacggagattgcggcgggagaagaacttcagctggactatgaagaaaaaaataagactctttcggataaggtggatttatattggcctgcctatgcccaattttccttcaattcctccctgaaagagcagctgatgtctgagcttccgcttttttatccccagatccgggatctggattgtgcggcgcttggaagccttgacgaggaaaagaaggtacaggtggataaatacctgctgatccttcaggtggatgcgcctctggacgcagagcaggttgctaaaattgaagagtggtcatccagaatcatagacggtgatgtgctcgcttcctggcgtctgcttcccggcgtatccgataattcggtatccggaaacagcgtttcggaaaacagcccggaggaagtgccggacagtaacggagaatgaggaaacagaatgacagatatgaacagcattttcgataaaaatacggtagattggttcgccgaagcccttggagaaccgactccggttcagaaggaggcctggcccgccattgcgggaggaaagaatacactggtgtccgctcctacgggtaccggcaagacgctgtctgcctttctggtgtttatcgacaggcttacgagacaggcgagagaggggacgctgacaaggcagcttcatctgatctatatctccccgctgaaatccctggctgcggatatccgggaaaatctgcgaaggccgctggacgggcttgcgggccagggcggagaagaaattgaaatcgccatccgtaccggggacacacctccgagagacaggcagaggatgatcaaatatccgcctcatattcttatcaccacaccggaatccctgtatctgatgctcacgagcaaaacggggcagggaatactggccacggcgaaggctatcatactggacgagcttcacgccctgattgacaccaaaaggggtgcccatctcatgctgtccgtagccaggctggataagctttgcagtcagccgctgcagcgtatcgggctgtcggctaccatcgagccgcttaacacggcggcggcctacctgtctccggaaccggctgccattatcgctcctgccatgaaaaaggaagtgcagcttgtggtgacaagcccgtttgcggatgtgacggccggaaaaaggaaggatccggtatgggaggaactggcggagctggtatatcgccactgccagggaagccgaagcgtgattgcctttgtggaagggcgcagatatgcggagaaactggcatactatgtgaaccggctgggaggagagggttatgcccgtgtccatcacggaagcctttccagagaacagaggtttgaggtggagcattccctgcgggacggcagcctccggctgctgtgcgctacctcatccatggagcttggcatcgatgtgggtgaaattgatcaggtgcttcaggtaggatgccccagaacgatttcgggcacgatgcagcgattgggccgtgcaggccataatccggggcgggtgagcgtgatgtatctgtttcccagaacggcggcggaaagcgtatcctgcgggatgacggcagagcttgccaggcgcggcggtgtggaatatgccagaccgccggtcggctgtctggatattttggcccagcatctggtttccatggcggcattccgcagttatgaggtggaggatgtgatggaaatcctgccaagggcctattccttccgggatgtgagcagggaagacgtggaaggcgtcctgggcatgctggccggtgatttcgaacatgaaagggatattcctgtccggcccagaattttgtatgaccggattcacggtcatgtggagggagacggctacagcaggatgcttgcggtatcggcgggcggaacgattccggacagagggctttatgcggtacgtacggaagaaggcgtcaaggtaggagaagtagacgaggaattcgtctatgagtcccagaaaggggaccggttccttttgggagcctttgcctggcgggtgctggatatcagcagggattcagtgacagtgacacagtcgcccattgaaggagcaagagttcctttttggagaggagaattaaagggcagggatttaagaaccagcaaggccttcgggcagattttccatcagcttcaggaagccagtgagaaaggagagctgatgcaggcactgtaccggctgggactggatgaagcggcggccaaactggctgaagggtatttaaaaagacagatagctgccacagaggggctgccggatgataaaacaatcctggtggagcatttccgggatcagtccgggaacgctcaggttatgatccattccctgttcggaaggagggtgaacactcccctttcccttctgcttcaggaggctgccagggcacagaccgggcagaacgtgggctgtgtggatgaggaggacggcattctgctgtattcctatggtcaggagagtctgcctgagggactgcttttccaggtatccccggagacttctgatgctgtcctggaggctctgcttcccgccactcctttgtttcatgtggcattccgccataacagcggaagggcgctgatgatgggagtgaagaaaaacggccgtcttccgttgtggatgcagcgtctgcgcagcgcggaaatgcttgacaccatcgtaagagaaaaaaagcatcctctgatcctggaaacaaaaaaagagtgtctgacccagatgtgggatccggagggagtaaaggaaatcctccatgatatccgttccggagcgattacagtccgtgaatttcattcggatgttccttcccccatgtctcttcccctgcagtggcagcaggaggctgcggtcatgtatgactattatcccacgccaagaggcgtccatgcgtctgtggaagaggaactgaagcagatacagatgatcgccgcgggaaaggaagagctggaacgggttcaggaacgcagccgtcttccggaggatgagaaacagctgcatactcttttgatgacagaaggagatctggcggccggagaactggatattcccatagaatggctggaaagcctggcggtccagggccgggcagcctatgtggagccggggctttggattgccatggagcacagggaggaatacctcagtgcgctttccgatccggatgaggagcagcatgcaggaaggaattcccggaaaaaggaagccccggcagatgagccggatccggacagccgcctccatatcgtaaggcgactgctccgttacaggggagcgcatacggcacagcaggtggcggaacgttatttctggccggaggaagaagcggaacggatactcgggattcttgctgacaaggaagaggccgtggaaaaggatggcgtttattaccacggaaggctgtatgaccgggcgagaagagagacgattaaaaatcttcgcagccaggtaactacacagcccgcttcttcttatgcggctctgttggcttcccgtatgaccatccatgcgccggcggcagaacagctggaacggacggtcggaatctatgcgggcaaagcggttcccgcggcgaactgggaaagcgttatcctgcctgcgcgggtgaaaggatacagagaatccctcctggatgcccttttggcggaaggcaaatacttctggcatatggaggaaccgggaatgatacggtttgatgaaccggaggatattgactgggatacgcctcctgacagcagtccggaaggccttacggagaaagaacagatggtctatcaggctctgctgaagagaggagccagcttcatgcaggctctgcagggagtgctgcccggagaatcccctcacgaaaccctgctctcccttttagaaaaggggcttgtatatgcggacagctttgtgccggtaaggcaatggcttgataaggataaaacccggaaggcgacggcaagacagcgcgtgaatacgcgggtaatggcgctgcatgccggccgctgggatgtggtgagacctctccgggaaagaaaagagcaggaatgggagcgctgttttgacagaagcattattttgtgcagagaaacggcggcggcctggaatgtgtcctggcaggatgcgcttcgggtactgcggattcaggaatatacaggacaggtgcggagaggatattttgtggaaggcttgtccggtgcgcagtttatccgtgacaaagatttccacagcgcccttcttgctcttgaacagccgcaggaagaattaagctggctcaatgccgcggatcctgcccagatatggggtaaggtggttcctcatctggagggcagaagctttaccaacgtgccgggaacggcggtcgccataaaagcgggagtgccgcaggcggtttttgaacggcagggtaagacactgcgtacattcggagaatgggatgaggcagcgggaacacaaatgctgcagagctttgcggcggcttttcgcggcaagactttgttcgccgggataaaaagagtggtagtgaaagaatatcccgccgaatcggctgaagcgctggcagcagcaggctttatcagggaaatgcaggattatgtcctgtatcggtaacgcgggaggaatgcggcggcgaatatgatatccatactttttttgatactgatttttatatggttttataaaaaaagaacctcttataacccttatgatatcagcctgagccacagctcttactatgagtgcgctttctgccgggaagaaaaatgtacggaggaagtccttcgtattctggagccggtggccggccataaaagaatactgaagaatgttttcctgcaaggggaaaaagacggccgggccggagccgatgtggttatgattcatgagtccggaatctatgtgatacattccgccaatctggagggtgtcatagcgggaaatccccagggacgctactggaaacagaccttccgtgagggctggctcctggcctgcagaaattacctgtacaatccctttctggaaaacaagaaaatactggatgttatgcaatgggaattccgggatatgccctggcttccttattattcctttgcggttttcgggaaccggggcgtgcttcttacatcgggatggatgggggaaaactgcttctcactgccggttcatgcactgtcttcggtggtggcggatgttttccgctataacagacggttccttaaagagcaggatattgaaaggatatatgagagaatgaaaaataccttgcattcatgataaggtcatgataagataagagaaattcagaaacattcaggaaggaaaaaagatgatcggttgtatccatgataatacaattttagacagattaccgatatccctgtcaggaattacgcatgtattttcccaggttacaggtggagtctgcccaaaattgcataattggaagaaagtaaccgacgtcagccgtgtaagataaccggctggactgaactgtttttgaatgggaaataattgttttgtccgtgatataatgtgcaggacagggcataagaaaatgatagaacggatccggaggctgcttttctccgggtcttttttgttatagaaaataccgtttcgatttttctgtcctcaggaaaacggaagggtatgaaaacagcgggaaggccctggcagtgcgtactgccggagccttttgccatgcatctgatagatgtatacatccgatggaggtatgtatccgatggatgcatgtatctgacgggcgcccgtcggggcgcagtttatcctgccggcggctgcattctatgggaaaagcagggggagaagcctgtggatgcggtgaaggaggaaatgaaaatgatacaggtatcatgcagtcaggtaaaaaaatattatggagcccagcttgtcctggagaatattacatttgaggtacaggaaggggaacgtgtcgccataatcggcaaaaacggaagcgggaaatccacggttctgaagctgatcacacgccaggagatgccggatgaagggacgatatcaattcgtaaaaatgcagtgacaggctatctggaacagatgccggaatacggcaagggaatgactgtaaaacaggtatgccgtctggcttttgaaaagctggatgggctccgggaagaaatgaaacgtctggaaagacagatggaagcccttgcggaggagggtacactatcggaagagaatgccggccatatggatgaaatattaaagagatatatggctctgcagacaaaatatgaaacggagggcggctatgaaacacaggatcgcttcgccagaatctgcacagggctgaagctgtccgaaccctttttggaggcggagttcgacagactcagcggcggtgaaaagacgctggtatgcctggcaaaaacattgctccagcagccggatcttctcatattggatgaaccgaccaaccatctggatatgtccatgctgcaatggctggaagaatatctgaaagcgtaccggggaaccgtgcttctggtttcccatgacagatgtttcctggatgcggtggcatcgaggaccctggaagtggaaaacggcgtggtggaggaatacctgggaaactattcttactacctggaagaaaaagaacgccgtatgcagctgtggcaggatgcgtataaagaacagcagaagcagataaaaagtatggaaaaggcaataaaagatatgcgtatctgggcggcgcagggagataatgaaaaaatgttccagagggcggcatccatgcagaaacgtctggatcgcatggaaaaagtggaacgccccaaaaaggaaggaccagggatgcgggttgctttcgggcagggggaacgttccggtaaagatgtccttcatctggaaggcgtgtcaaagcgtttcggggaaaagcagcttttcaggaacctgaccatggatgtccgctataaagagcatgtagcgcttcttggcaggaacggctgcggcaaaacaacacttctcaggatggttctgggggaaatacctgcggatgaaggaatcctcaaattgggtggcagcgtgaccgtcggctatcttccccagcaggttcatttcccgaaggaggatgtgagcgttttagaagccttccgggacgggctggtgatcggagaaggcaaagccagggaagagcttgcccgatacctgtttaccggggagaacgtatttaagaaggtggcgaatctttccggaggggaaaagagcagattatatcttgcaaaactgatgcagacagggatttatactccgcagaatgcatcgaattcttctgtcggaggaaacgatgaaaacagcggtaaaattaatttcctgattctggatgaaccaaccaaccatctggacattatctccagggaaaacctggaaaatgcgctggagcagtttgagggaaccttgcttatcgtttcccatgatcgttatttcctgaataaaatggcgacaagaatagtggaaatgacggaaaacggagtatacagctaccagggtaattatgaggattacaggcatgaaaaagccaaaatggaagcatcgggaagcagcggaagcgatgcggcggaaaagagcagccgttcagaagaacgacggactgctgttgaggcccctgtgagagaggcacatccggctgcacaggaagaaaaacgcggaggaaaaaaccaattccgtcaaagacagctggaacaggaaataaaaacgcttgaagaagaaaaaagcaggtatgaagaagaactcgccgccgcaggaagcgattatgaaaagcttatggaaatggaaggcagaaagaaggaaacagaacggaagattgaggagaaattagaagaatggcttctgctgactgaaagctgagaatgaattaagccgtgataccccgctgcctgcgcggggtatttgaattttatgattgacaataatagtactatatagtactatcctatataggaggaaaagaagtgagagcaacgaatggaggttttctgatttctcaggtaaagcaggtacagggaagagtttttgatgcgatgctgcaggaagcgggaattgaagagtttaacggcgctcaggggcgtatcctttatatactatggcaggaggacaatctgccaattgtggaactctcccggcggaccggactggccaagaccactctgacaggaatgcttgacagaatggaagagaaaggcatcctggagcgacgctttgataaaaaggatcgcagacaggtaagaattatcctttcggacaaggccagggagctgaatgataaatataaccaggtatccgatgccatgaacgaacgtttttaccggggctttaccgacagtgaaatcaaacagtttgaagagactctggagagaatactccggaatcttacacaggaataaggaggggaattcctatgctgcagtcagtcaagaatgatatccgcaggcttgtggaaaaatcgggaaaagtatatgtatcctccgtggatgaggctggctatcccaatacaaaagccatgttcgcccgtgaacacgatggtatgaagatacattatatgtccacaaactgttcttccctgcgggtaagccagttccggaagaatccgaaggcatgtatttactactgcaatgaaagatttttcaagggtctgatgtttaccggaacaatggaagtatgtacggatcgggaaacaagggaacggatatggcgccggggggatgaaatatattatcctgagggagtggatgatgaggattactgtgtcttgcgttttacagcggagaagggtaattattatcataatctgataaaagagattttttctttggaggaactggaagaagaacaggaggaaaactaatatgaaggcaatgggaccggaagaagcatgtttttttacacaacaagtatatttgataggaaccgaagatgaagacacaagtcccagatttgcacctatttcctgggttagctatagctggggaagtccggcctgtctggttatcagtatttatggaacgaagcagaccaagaaaaatatagccagaaccagacagcttactgcaacggtagtgacggaagatatgcttccttttatagaacagtgcaacaggcaaacctacagaaaagaagccatggaaagtctgcatgccgatattattcaggcagaaacagtgcaggcgcctatgctcgctgatggaaaatttgcctatgaatgcgaagttattaaccaggtggaactgggagagacaacgacttattttgcgaaaatcaataaaatatgcgcttccgatgagatacttgcacttgatttttttgatctgagaaagattaaaccagtgatttattcgccggaaaactattttcttccgggagaacaccttggaaagattggggattttagtaaattgtaatctgccggattggataaggatatattgctgccggttaaacaaaacatcatttatttcttgaatatgcttaaaaagtatggtaaagtattcgaagattggaaatgaagttcttccatggtaccggataccaacggattacctaaaccgcttgacagctgatgacttctgcgacaaatatttcgcaggggcatcagcttttttgctgttgaaaacaggaagacgggaggaaaataacatgttattaagtcttgcattgatttttttatgcggtcttgcgctgggaggaattttccggaagctgcatctgccgcagctgctgggaatgctgcttacgggaattttactggggccttacgtcctgaacctgcttgacagctccattcttggaatttccgctgatttacggcagattgccctgatcatcatacttaccagggcagggctgaacctggatttggaggacttgaagaaagtaggcagacctgcggcgcttctgtgttttgtccccgctgcctttgagatcgcaggcatgctgcttctggcgccccggcttcttggaatcagcctgctggaagctgccgttatgggaactgtggtggctgcggtttctccggctgtggtagtaccgggtatgctgaagctcatggaggagggctatgggaccaaaaagagcatccctcagatgattatggcaggagcttccgtagatgatgtattcgttattgtccttttcacttcctttaccggcctggcaggcggcggaggtatttctgcatgggatttcgtgcggattcctgtttccatactgctggggctggcaggggggattctctgcggcatactgcttgccgtctttttcagaaaagtccatatgagagacagcgtcaaggtaatcattattctgagcctgtccttcctgcttgtgacattagagcatgcattgaccggcattgtgggattctccggcctgcttgccgtaatgagtatgggaatagcattacagaaaggaagaaaggaagcagcggtgagactgtccgccaaatattccaaactgtgggtggcggcagaacttctcctgtttgtcctggtaggagcggcagtggatatcccttatgcattcaaagcgggagctgctgcagcggccgtgatcctgggagtattggtattccgtatgctgggagtcctgatctgcctgctgggtacggaactgaacaggaaggagaagctgttctgtatgtttgcctacatgcctaaggctacggttcaggcagcgaccggttcggttccgctggctatggggctggcatgcggaaatattgttctcacggtggctgtgctggcaattttgataacggctcccgcaggcgcatttttaattgattttacctataaaaggtttctcagcagatagaataaagcggcttccttgaaaaagtatctcacttcttcctttttctatggtacaataccgtaagaggggatattcctgaaacaaatacaaaataacgcttcctgataagacaggtgttaaaagccggttttatcaggagcagcaggagacagaattgtgaataacagcattttggaagcaaaaaatgtaagtaagaagtatgaagggaaaacggtgctgcaggatatcagtttatcggcgggaaaaggagaggcgatcggcctggtaggtgtaaacggatgcggaaaaagtacgcttttgcggatcctttcgggtctgagtaatccttcttccggtcaggttagctgttctccgggcatacggatggcattgatcccggatcggtacgaaaaaataaatatgactctgcagaaatttatggatcatatgtaccgtatggaaaccgacagggaaaacagggatgagatgggacgctatttccgggagttttatctggaatccatgctggatacaccgatgaaatatctttcgaaagggacgctacagaaagcgggggtgatacaggctctgttgggaagaagggagctgctgtttctggatgaaccgctgtccgggcaggatacgctgtcgcagatgacgctgattcaggagttgaaaaaaagaaaagcggcaggaatgactcttatcatggcctgccatgaaacatatctcatcgaggagcttgccgaccgtatttatgaaatcaaagacgggcatttggaggatgggatatcatatgtatacggcatacgcaggaaaaaggcaattttactggtaaagtacggagagaattccgggcagataaaagaacggcttgagaagcagttcggggaatctctttatgggatgacggattacggaagcctctgcaggctggaagcagatgttcagattgcagaagaattatttcgatttttcggagagataaaatggcatatagtcagatatgaggaggcagaagagttatgctgaaggagttgtttcgatttgaaagagataaatatttccatagcagcagaatgatccttccgcttatcctgctgttcttttatctgggcttcgcctattccatggctccccagtatgtgctggacagcttcagcatttgttcgctggtagtattcctgctgatgctttccgtggggattatgtatgatgatatcaattatcctatgatagatcagactatattcataaagacggaaaagaaggagcagattttcggcgcaagatgtgtcctgattgcttatataagcttcggagcgtccgctgcatgcgtagtgtatcctgtgcttgtggatctggcaggcagggggaatctgtttatgcggccgcttcgtcctgaggatctgatatccgctttctttcttttctggctgattgggatctgcggaggagttaccgggctttttgccaacagccgtttattcaaaaaaagagaagcggccctgctgttaggggccctgctgggactggtgattattctgaaagggcctatcggagaggaattcccgcccacacgtctgcttacctggattctgccgccggtttatgacctgagcgtgaattactgtaaagaggattatttctccctttcagcaaatggaatatattttttctggcttgcaggatatactggaatagaaattttcctttatatatggatgatgaaaagaaaaaagtttgaataggaacattttgggaataatgaatggaaaaagagcctgtaccaatgcggaatgaaccgtggtacaggctctttatgtgcggtatattaatcttcagaaaaccttcagtccagaattccgcgtacggggttatgggccatggcggggcctctttcataagaggtttccagttccatatagcgtccttcccggctgcttttttcaaaggcagtcatgatttctaggacatggagagtctggctgcagtccgcccggcagccgcggccgcagcgaagggccttcgccatatcagccacacccagtccgcggctgttatcctgataatcgaataccagagggatttctttaaagcttccttcttcaggacgcaggagagtaatacttcccccgaacccattggggtcgggaacacggagggttccttccgtaccgtagatttccagtttgtcctgtctgtcataatatacgtcaaaggtggtagtaaccgtagcgactgcaccgtttgtaaactggaggataccgtttacgtgtgtgggtacctccacgggaactacggttccgcatttgggttcactggtgatggtacgtgtttcaaagctttttgtgaccagaccggtcaacccttttgcactgccaagcagattaaccagagcggtcatataatagggacccatatccatcatagggccgccgccatactggtaataaaattcaggagagggatgccagctctcatgtccgtggcagatcatctgcgctgttgcgccgatggggcggccgataaagccgtcatcaatcaatttgcggcaggtctggacagcggcgcccaggaaggtatcgggagcgcctcccagcagaaggcctttttcctgtgccagagcaacgagttcttttccttcttcaaaggtggcagccagaggtttttcactgtaaacatgctttccggccagaagagccgccttcgtggtttcataatgttcaaaaggccgtgtgagatttaggatgatttcaatatccttatcctgaaacatttcttccatagaagagtaggctttgggaattccatattccttttgcgcctgttccattttttcggggattaaatcatatatgcccacaacttctgtttctctgaacaggccggtgaggtttttcagatagattccgctgatggcacccagtcccagaataccgattctgacgttttccataatagctcctttccgtgataagcctctttttagtacattttggctgtgttttcgaatctttccgtagtcagtccgtgttcggcggcatactgttttccttctgcggcccacagcattcctctttccatcaggatctgtgcggaaggagatttatcaaatacgtcatcgtgatgaccgagggagttatagaagactctgccgttgccccagaatttagtccaggctacaggcatatcaaccactttattggagatatgataataaggcacaaccgggaaacgggtggttgccagtacctctaccgccggatccacatgcaggtaatactgttcactgcatacggggaaatcctccaggccttccacaatagggctggaacccttgcggatatttacctcataggaaattccatcgccgccgggatggcttacccactggccaccggtcataaattgccattccacatcattgcggaatgcatcgcacataccgccgtggcagcctgcgagccctgttccggcagcaacagccttaacaatattctcacggacctttgtatctatctcacccattgtccagcagggaatgattaaatcctggctcattacaagctccagatcaagcattacctcctgattgtcataaatgacacaggaataaccgtttttctccataatacctgcaaatctttccgctatcagatccggttcgtggccgtcccagccgcctttgaaaatcaataccttttttgtatctgtcatttgaatgctcctttcttcctcatataaggaatcccttttctcttaagaagagtttctgtctcctgcggagaagttctttcttctttgtgcttgtattatagcaggccggggcgtataatgattgccataatgcaaatagaagtggccataaattgctgtgatggaataagaaaccggatgaaatgaaattttcgggattttctgatcggaacaggagcctgtatgaatcctttttatgaaaaaagaagcggtaaactgcagatcggagtatcggacaatatgaatttcccggcccatctgcatgatgatgtagaagtgctgtattgcctggaaggcggagtccaggtttctgtcatgggagaaacccacctggtcggcaaaggggaatgcgccgtgattttcccggaacgggtgcacagttatcgttcggaggataatagcagggcgctgttgtttattttcagtacggctatgtccggtacgtatgggaggactatccagaaatattatccggagaatccgtttctggaaaagaaagatattccgccggatgcgaggctggcattcaggcgtttatgcagcggggatgtacagaaggatgataaactctgtatcgcctggattcaggtgattctcgcaagccttttcccgcggtttgagctccgcgaggatgaaagaccggaggatatggatctcacataccgtctggtaaggtatgtgatggagcattttcaggaacccttgtccctggaggaactggcaaggaatctgcatgtgaataaatactatttgtcccataccttttccagccggctgcagatgaatttccgtgagtacctgaaccggatcaggctggaatatgccacgcagcagatccgttccacgaggaaaccgctgacggaaatatgggaggatgccggttttgaaagccagagaagctttaaccgtgtttttcatgaggcagtggggatgtcacctaaggaataccggggccggggatggtaaagggcggggataatttagaacagaattgcatatcgttctttacgcaggcgcatttacgatatataatgataaaagctgttggactgcctgttttcatatacggtaaaaccgggcgggcttttgtttgggtatttgtaataaaggagggtggtaattttatgactacagatataacttctgcatagcaagggctattgcagatttcgtgaatagatacgtaatagcctttgcttatcctgaattcatatttttaggagggcagaatgggctacagaaaggcagtgaaaatattgccgcccgaggtggtggcattgatacagcaatatgtggatggagaatatatttatattccgagaaaagaagagaacaggaaaagctggggagaatccacggattaccggcgggaaatggaagaacgcaaccgtaagatttatgctgattacaaaaacggcatgaatacggaaatgctttccggcaaatatttcctttcagataaaagcatccagaggattattgcgaatgaaaaaagaaaataagcacaggaagaggattccacagcctttcgcaggcgggaatcctttttctcattcttttttcctaaaaataggtgaggaagaagttgaggtaaaattatgttatcctgtaatcagccggcaaatacagggaagaagatacagaaaaaacgaactgaattcttccgaagagggaggacagctttatgatgaaagatattttttgtgcgtagcagaggctattgcatgaaattataatatatggcgctttcgctcagaatgaggaaggcattccagtcagtaaatataaagatagtgagaatagcttctgcagtttctaatcgcaaaaaatagaaacaggagttgcagatgagctatataaagaaagaggaatggaccattctgccgggagaagcccctgctatacgcaggaactgttccggctgccggaaaagcagtatattcagaagcagcggaaatttcaggatgaatgccaatggaaataaactggatgtgtggctgatataccgctgcgaaaaatgtgatacaagctggaatatggatatttatacaagagttgctcccggaacattggggcaggatttgtataaccggtttctggaaaatgattcggatacagccctggatttcggctgccggaaagaaattctcagcagaaataaggcggaggcattatgggaacaggtaccgtttaaggtggagaaaacgttccatgaggccaaagatgccagtgagacattagattatgcagagaggatgatttctgcggaaaatacagttcccgtggaaagaatagtttccgtggaaagaatagtttccatacacaatccttatgaaattccgatgcgcctggacaagcttctgtgcagggaattgaactgttccagaaaggatgttgcctgtctggaggacagcggaggtctgtacatcaggacaggagggaaggacagcaggtccagaatccctatatatatggaagcagagatcagggagccgttcccgcggggataaccgcgggagcggctccccgttttttgagctgtaaatccggtacggttaatttattggattctgcgaaaaaaaggcagtgtaaaataagggaaggctggcttatttaattttctcagacttgacttataaatattacagatgtaagatatgaaggatatttgtattgatactggccgtgcattttgtccgggcagacatcttttatgtataaccagtgaaaagcaggaacaaaaggaggttttatagtgaaatacaggaagaaaaaacttctgattttactttactggcattggccggatgcggcagcagggcagatgcagaaggggaagcaggagaaataatagatgagcgtccctcggcaatgacagaaattgccgcaactgtttcggataaggagggagcaggggaagtttcggaaaatgacattgtcagagagacaatagacatagctgaatcatgccgggatatttatgaaaaggcagtacaggaaaatacagcaggcaatcaggagctggtgcgggaactcataggccgccttggagaaatcggatatgccgcagtggatacggagaatcagattgacatggtaaactccgggcttataaaacagttctgcggtaaggttgaggaaaagcaggaagcaaagacgacgctttttattgtgatggaaaacggtgatttaatccgcaatgaactggatacttccgaaggagaggaggatgttacaaggcttgtgctgaattggaaggatgggaatccggatgtaagctatcaaaatacgtatcaggcttattcatggacgtatgaagataacggatatcttttttttgaagaatactgcccgccgggatttgatggcgccccggggtatacggctgtccgtgtggaccccttggatccggatctccgggagctgaacgacaggtatattcttcctgtgggttatgggctgaacaacatgtttacctccgattggagtgaagagaacttcggggaactgaatttctatgatttgtatgaacggatgtatcagatgaagtatggcagcgggccttttgccgccacaattgacagtgaggcttatcaggtgccggaagaaatttttgaaggcgtatttatgacgtttttcgggatagacagccgggcgttgaggaggagtacggtttatctggatcaggataaggcttatcaataccgtacgagaggccaatacgattttgcccccattcccggtgtgccttatcctgaggtggcggcctgcgaagaaaatccggatggaacaatcaggctgactgtgaatgcggtatggccgaaggagcatcttgcacgggcgttttcccatgaagtggtaatccgtcttttggaagacggcagttttcaatatgtatccaatcatgtgataccgtcagagaagaatgtggagccggtctggtatacggacaggctgagtgatgaacagtgggaagaatactatggatagagggctttctcctgtaattccaaggtgaataaagaacagcaattgctgtatatgccagccgggttggaacggctggctttttttgccggtttatgccatgcagattgtgtataatgcgcataattgatgcgaaaacaacaatatttagaaacataataatgaataaattaatgaagctatatgggtggatatacaaaactaaaaaaataacacattctgcaataaatattaagtatatttgcacaattttaatttatataataagcttgttaacaaaaaacgtatttatattgtggagggattcgttatgaagagaaaatctgtaagtattgggttagcggctcttttggcagtgtctctgttggcgggctgcggcggaaagggcgctgcggaaaccggaagcacaggggataccaaagctgtacaggaggcggataataccggaaatgcagaaacaacagggggcggtaccggcgaacaggtcactattaattttcagacctggaatcccggggaaggggcggctattgatgaggtaatcgcagcttttgaggaaaagtatccgaatatcaaagtgaatcatgtatacatgccctataccgatcatgtggaaaaattgaaaattgatttagccagcggagagggagcggatgtattcggaatgcagaccggcgcgacgatcaaggaattccgtgattttgaaatggatttaacgagctatgcggaagagtcctggggaagcagctggaaggatcagtacatggacttctgtatggatcttctgaatgaagacggccattattacggtcttccgcttggtcttacctatgcaggctttacctgggcggatgtaaatatgctgaaggaatacggtctggaggtgcctacttcttatgatgacttgaaggaatgcgcgaaggtactccgtgaaaacgggcagtatccgctgactatcggagctaaggatgcatggattaatattgatacctggatgagtatggcaaatgatatcaatccggaaaagctgtactctgccatagaaggggagacaccctttacggatcctgatttggtggaatccttccgcatctggcagtcctgctttacagaagggattttccaggacggagcgcttggggtaggcgtttataatgatacctcagacctctttgaaaaggaaggaagcatacccatgattcagaatggctcctggtccgcaggcttttatgtgagcggggatccggatcagaaccgggttttcaactcggaaggggcggatcatgatattttccttattgactggaataatgacggcaaggtatgtccggtaacggcatctgtggatgtctgcctgtgtatgaataaaaataccaaaaatccggaggctgcctggactttcattgacttcatgcttcatgaagggcaggatattctgattaaccgttatttttcatactgtccttccagaaaggatctggagctgaatgtagagggaatgaatcaggatggattggataacctggcatacattgtggaacagtcagagaataatctgggcggatatcgggaaatggcctatgcggatttaaagcaggttatcagtgatcagctgaccgtcctcgcattgggagatgcaacaccggaagaagcggcggcggcaattgaagcggcttcccaggcacaggccagataaaataagcagcaatatgcggttgtgccataaaaagagggcgtcctttaccgcgaagaagacgggaaggggcgtcctcctgaaggagggaagagccatgaaaaagaaatcctgttcagggtatttgtttatcctgcctatcgtcatcctttttctgatatttattgtatatcctatctgctataacttttatatcagcttttatgaatggaatggtatcaatatcgacaaggtttttgtgggactggaaaattataaaaatgtgctccgggatcccatcatgcagaaaatcatcagaaactttgttgtttttgccttgtttacgattattattcaggcattctttggtctggtatttgccgactttttcataagaaaattaaaatttgcatctttctacaggattattttttatataccggtaatagcaacgcctgcgattgtcggaaatattttttcgaaaatctttgaaacgaacagaggatacctgaatgtatttctgcgtttcctgcatctggatggcctgtgccagcagtggctggccgatccgaaatgggcgcttgcctgtattatttttgtgaatatctggcagtggacgggatacagtatgctgatgtattacgcgaatatgctgaacattccccaggacctgtacgaagcggcaaccatcgacggagcagggcagatacagcagtttgccaagatcaccttccctcttctcagaggaacccattatacgctgttcatcatgggaatgctgggatcgctgaaatgttttgatcttccttatgtgctgaccagagggggcccgaattatgccacagagtttttttccacttatatttacaagcagtcctttaatctgttcaagcaggggccggcatcggcaattgtaatggtgatgtttgcgatagccatggtgattacgctgatacagctgaaattttattatcggaatgataaggataaggagttggcgggctgatgagaaaatctttgttttttaaaatagcaggacagctgatctgtatcctggcaacggcactttttctgtttcccctggttctgatgcttatccgttcttttaagggggaaggcctgcataattatgtaagggtttttgaaaccgtgaatctggcgccgaactttctgaccagcattaccgtagtattcggtacgctgctcattgtttccgcagtggcggcgatggcggctttcgcgttttccaagctggattttccgtttaagaaggctatttattatatgcttcttaccggaatgatgattcctacttcagcgcttattttcccattgtttcaaatcgtaaaagggcttaaaataaataatacacctttttccctgatttttccttatgccacactgaactgctgctttaacctgatggtgcttaagaattattttgacgcactgccgaatgagctgatggagtcggccaggattgacggggcgggaaaagggcggatattcataagcattatgatgccgatagcggttccgggactggcctttgtgctgattcagacgttcctttccgcctggaatgagctgcagatggccatgatttttattaatgacacttccctgcagccgatatcggtggttcctctgcggtttacgcagacagcgggggtgcaggggtttccgctggaggtgatgtatgcggcgctggtgatttgcctgagcccgatagccgtattttatgtattcggatcccggtttctgatagcggggctgacacagggagccataaagggatagacagcaattgacaggaaatcccggcagcttggtatgccgccgggaaaggcaggaggattttcccattatgaaaggcgttccttttattttccggatacgcaaaagcctgagtactaaaattacagtgatgaatgcagggatcattctgctgatttttatcagtctgatattgactacggtatcgatcaattatcagcttaccctggaaaatgaaaaacagaaaatgaatgtgtatatttccaataccctgagctccattgacaataagctgaaggatatggggagggtttcactcatgacctattccgatgagaggacccaggaaatattgaaaaattatgattcctttgcgtatgcggagcagctggataatgtggaatatctgaggaagctttacacctcgcttatcaccatacgggaggatatcaattcggtctatatttttgatttggattccctggtcttctggcaggataacctggatccgtccatgcggagaaatatggatatgtccgtattcctgaaacggatggaagaatgggagagcaaggaaaggagcgtgtcgggctgccgtctggtagtcggggtgcagccggatttcatgcgctacagcacgagaaacctggaagatgaatataccagacattgtatctatctggtgagggagatcaaaagcttttccccgaatgaaccgattgggcatatccttctgatcaccacgatggaaaatatcagggaagttctgaacgaatatctggataaggaagtggaatacacgcttctgacggaggaaggggacattgtctgcgatgaggaggcggagtacctggggaaaaatataagggatgcttctccggaaatctatctgcggatgaatgaggagaagggggtgttccgggaacggatcagaggaacggactgtctggttacctaccagaaatcccaatacagcggtatgatactggtgacgagaagggcgatcgctcttatttggaaggatgccatgcgtttcatcggtgttacggttgctgttttccttgtgattttgggaatcaccgtagccatgaccttccaggggaccaggaaaatgcttcggcctcttaccatactgacagattcgatggcacactttaaccaggatgacatgggcatgcgttttgtggttgcctcagaggatgaaacaggcaggcttgtggcgtccttcaataaaatgatggatatcattaaccagctgatagaatcggaatatgaagggaaggtacgtctcaaggaggcggaattgaagcagcagaggatgtccctgctctatctgaaaaaccagatcaaccctcatttcctttataatacgctggatactatccggattaaggcggaactgaacggagataaggaagtatccgccatgatcatgcagatggttgattttttccggctgagtgtgaaggcggacagccagatggtgtcggtaagccatgagatccgtttgatacaggcttatctcaagctgatgtgctgccggtacccgttcctgaactgcgaatatgaaatagacgagtcgcttctggatgtggaaatgcctaattttattctgcagcccctggttgaaaacagtgtcatgcacgggctgcggggagtgggctatcgggggacggtgcggctttcggtcagcagggatgagacggacggtgaaaatattgttatacgtatctatgataatggggcaggattctctccgggaacccggagcctgctggaaaatgtcctgcagaatgcaggggatgatacctgtgaaacaggtacggaggaaatgcacataggcattgtcaatgtgcagagaaggctgaagatgttttatccggacaccgcaggtttgtcctatcaggataacccggaaggcggggttacggtgacattaataattaagagcaatgtagaaagagagggtttgaaatgagaaaactggattttgcaacctacaaagacaaggttatgggctgctgggccggcaaaaacatcggcggtgtgctgggggcgccgtttgagggaaagagacaggtgaatgacatttccttttatacacaggatctgtccatggggcccccgcccaacgatgatctggatctgcagattatctggctggcggcggtggagcgctatggcaggaatgtgaatgcttccatattgggagagtactggctctcttactgtattcccaactgggtggaatacggaacgggaaaggcgaatctgcgcgcagggctgcagccgcctctgtcagggctgattgacaatacttacaaagacagctgcggctgttatattcgttcggaaatatgggcctgcctggctcccggaaatcccgagctggcggcgcgttatgcctatgaagatgccatcgtggatcatgaaggggagggcatgtatggggagattttcttcgcggccctgcagagcgcggcatttgtagagagcgataaaagaaagctgattgatatcgcgctgtcttacataccggaggaaagcaaaacgacggcggcaatccgcaaagccatggaatgctatgacaagcacgtggaatttacggaggcgcgcaaagagattcataatacggctcccggtacctttggggttcagagcggaacgattcaggatattcccgcggaaggaaatgaaggaatggaaatcggtgctcccggttttgatgctccggaaaatgtggcgtttaccattgccggctggctttatggagaagaggatttcggaaagagcctctgcatggcggtggcctgcggagaggacacggactgtacctgtgccaccctgggagctgttcttggaattatcgccggtgcgtcagggcttcctgaaaaatggacggcgcctctggatgacaagatagccacactctgcatcgacaagacaagcggaggcatctgggtgccctccacggttacggagcttacggaacgagtgatgcgcgcggcacccggtttccttggccaggatatctgtgatatttttgcggacggaggaatgaccatcgattgtaaggaaggaaacgaactctactgcaaaaggacttccgattacattccgaaaatcaacggaaacggcaaggacgaagcgcttcctgtgaaagatctgtgcagcctgtcgccttatgtggtgagatattccttcccggcctttaatatcatggtggattatgaggattccatcttttttaaatccggggaaaccaggaaaataaaagtgactgtgacgaattcccataccatgaggcagcagcagtgggcgaagatcaacgtttatatgccgtcgggagtggagcttttaaatggaaaaggctatacccttccattaaataatctgtatggctccaaagccgaagcggagattgcattcaacacggatctttatgacggcggaaggcttgagtttgttgtagaggtatccttggaaggaagacattcttccggagctgtaaaagtaacgctgatgcgggaggcataaagaataagcccatgagccctttgcggccatgggctttatggtaccttgcgcagagaaaaaataggggaggccggtatgggaaattctctgaaggtaatgctggtggatgacgaggtgacaatcctggaaggatttaaaagactgtttgactggaaggcatatgggtgtgaggtggtgtgtgaggctctggacggggtaatggctgtgaaccaggccaaattgtaccagccggatattattatcatggatatcaatattcctgttatgtcggggctggaagctcttcgggtaatcagagatcagaacggggaatgcgcctgtgtcatagtgagcggctatgatgaatttgaatactgccgggaggcgctgcgacttcagatcatggattatattctgaagcctgtggatttcggggagttcggaaaagtgattgaaagaataaagctgaagctgatacagaacaaatgtccgcagacaggcctgtgtgcggaaaagccggtatatcagctggcggcctaccttcaggagcatctttctgaggatattaccctgcagaccctggcggaggaattccatttgaatccttcctatatcagtcagctgtttaaaaatgaactgggtatgaagtatcatgattacttaacaaagctgcgcatggacaaggcgaggacgctgcttgcctctacaggaaagagtattacggaaatagcgggagaaacaggcttcagggattaccgggttttcaccaaagtgttcaagagtgcggaaggggaatccccctctgctttcagaagcaggttctccattaactttccggaaacctgctgaataagaattgacaaataaggtttattactataaactaggtttatagtaataaaccttatttgcgtttcagaaaggaatatctgacgcagaaagcgaggaacccatggaaataccgagaataccggatggagaataccgatttgcagaattagtctgggacaatgagccgataaattccacgatgctgatccggcttgcccaggagagtctggggtggaaaaaggccaccagctataccgtgctgagaaagctgtgcgagaaggggatccttaagaatgagaatgccacggttaccgcacggattaagaaggatgccgtatgcagacaggagagtgagtatttgctgcacagaagcttcggcaattcgcttcctgctttcgtcgcctcctttctccaggataaaaaactgacgcggcaggaggcggaagagttaaaacggctgattgacgccgccagtgccggtgggaatgaaaagggctgaaagagcggatttttttgcagagccggaaaggagtcctgattatgtatgatatgcttcaaatgctgccgaagattgtaaacatgacgcttgccgcatcctttgcaggctgcgtggtcctgctgctgcgggctgtgctcaggaaggtgcccgcagggtatttttatgcgctgtggctcatggtattcctgcgttttctgtgcccctttacctgggaatccgcggtgagcctgattcctgtcagaggggatgcggtgacctataagtccattgtttctgccggagtaaatgtttatgcaggagtgagcgccgcactgcctgcggacagcgtgattcgtaaaatcccggctgcggcaggaaatatgggggtggattatgggaagctgctggtcggtttttgtgcggcggtatggattgcgggaatgcttgtttttcttgcgttcacgttccgttctttccttcggctgaaaaagcaggtggcggaggctgttgtcctgtatcctgcgggaaagggacaggcccgtgtttacgaaagcactcaaatcgattccccttttctgctgggccttctgcggcctgtgatttatctgcccgccgggatgaaggaggaagaaagacagcatgtcctggcgcatgaatatcagcatgttcgccgcagggattatctgataaagccggtctgttttctggcagtgctgcttcactggttcaatcctctggcctggctttttttccgttttatgacggaggacatggaacgctcctgtgatgacagagtgttaaaaaatatggatgcacaggaacgcgcgggatatgcgcagacccttctgcgcctggggcttcgtaataatggtatggggtatatgctgcctgcggctttcggggaaagcaatacgaaaaagcgtatttcccatatcctcagtttccgaaagccatccgtatggctgtgtgcggcagcgctgcttctggttgtgggggcaggggcggtgctttttacttcgccgtctgccaaagagggggaagcgcaggaggaagaaggcggcatgacggcagggcctctggaaggagaagcgctggcggtcgggctgtcggacaaaaggaatccgtatataggagatcacatccgggatgcagcgctgtttggtatgctgccggttccggagacgctggaataccggaagatggaattgcagacgacgcaggagccatacgaactgattatggtgtacgggctcagggaaaatgcggatatgccaagaaaggaatggagcttttccaatgcggttcagctctttgcttccatagaaaatgccggaagaatcagctatgcagtggaaaagggagcggaagaataccgtgttacctatgacagaagtgatgcggaggccattttcggtccgctgtatgcatattctgccgataaagataaaatgatggaacttcagaggcagatttcggcatatatggagaatggaaatccatcagatatgggtgaggaacgggtatatacgctgaattcggaaggaaacagaattccggggcaggcggaaccggatacagagcctgaaaaaacaggtggggaatcagaacagggaacagagtatggggaaacaggcgaagaatcagaaccggaacagacggataacctgcctgtccatatggaactggataaagaagtatattccgtgaaggaaccggtattgataatgacaatagaaaatctgtcggatcaaaatctgacctttggagatccttatgacttgctcagggaagaaggaggagaataccggcttgttccaatgaaggaaaatacaggctggcatgatgttttaaatgtgatcctgccgggaggaaaaacagagcagaaaatggatttgagcgtgatttacgaagggctggatcccggaaattatatgatcagcaaatcagccgcactggaagatgaagatggggaagccggtgattctattgtgctctccattccctttgtattatactagcgctccattcggccagaaacactactgacagtactgcctattttgccatctgccgcgttgtcgtcagtcaacgatgccaccgcatcgcctccttcctccgccttgcagactgacaaaatattcagcactgtcagtagcgtttctggacggatggagcactaggattaaactgaaaagcagatcaggaaataccggagtatattttatatgctgccggtattttactgatctgttttgtttataatgaatgattttcaaatatacatgcaggtgcgataggcacaattggtacgcctatgtatacattcagattgtgagttgtaaaatatatatgaaaatacggaaaaataattgataattttattcaataatgctggtcgaatggagataaatatgttataattttaacagtcatgcggccggctttttttattgccccggctgcatacaaggcggccggactgtctgaggggaacagtccggactgcaccggtataatgggattgataaaagctctcccaaaagactgaagacagtacggaaaacgagaaggaaaggggaagttacattttaatgagccgactaaaaatcagtacacctgaccgggcccagttaactgtggaacggttgtacaaggatctggaacgccatattgttgccagcccgccggggctttgcccggtcgacctgcagctgtcctttttgaagctgtgtcatgcacagacctgcggcaaatgcgtgccctgccgtgtaggcctcctgcagcttcagaatctgctggagcaggttctggacgggacagccactatagatacgctggcccttattgaggaaaccgcgaataatattacggattccgcggactgcgcgattggctttgaagctgcccacatggttctggcagggcttcagggctgcagagatgattatgtttaccatattgagcatggaaaatgctcttattccatcacacagccggtgccctgcgtggcgctctgcccggccggtgtggacataccgggatatattgccctggtgggagaagaaagatatgcggatgcggtttccctcatccgtaaggacaatcctttccctacggcatgcgccctgatctgtgagcatccctgtgaagccagatgccgcaggaatatgattgacagctccgtaaatatacgagggctgaagcggatggctgtggataatgccccggccaataccgtgcctgtaccgccgaaggctccgtctaccggaaagagaattgcgattgcaggaggaggccccggaggcttgtctgcggcatactatctggaattgatgggccatcatgcggtagtgtttgaacagaagagccagctgggcggcatgctgcgttacgggattcctaattaccgtttcccgagagagcggctggacgaggacatcgaagccattttgtccaccggcgtggaggtacatacgaatgcgaatatcgggaatggggagaatgacatccctctgagccgtctgcgggaagatttcgatgcggtttatatcgccataggcgcccataccgataagaagatcggaatggaaggagaagatgcacaaggcgttatctcggcagtggaaatgctgcgcaatatcggtgacggcaatcctcctgattttacaggaaaaagagttatcgtcgtgggcggtggcaatgtcgctatggactgcacccgttcagcgctccggctgggcgcaagctcggtggggatcgcttaccgcagacgccagaatgacatgacggcgcttccggaagaagtggaaggcgcaatagcggaaggggcggagctttacagcctgaaagcacccgtgagagtggaagcggacgaggatggaaatgtggcggccctgtgggtgcagccgcagataatcgggccgattgacgcctggggacgcgcccgtccggtacaggctgacgtggaactgaaaagaataccgtgtgatatcgtgatagttgcggtgggacagggaattgaatcccggcatttcgaggattccggcgttccggtgcactggggaacgattgaagccctggaagaggcttccgttaaagatattcccggcatttttgccggcggggactgcgtgacgggaccggcgacggtaatccgtgccattgcggcgggcaaggtggctgccgccaatatcgatgaatatctgggttaccatcatgtgatttcctgtgatgtggaaatcccgcaggtaaactatgcggataagaaaccctgcggccgggtgaacatggaagaacgggaaaccggtgaacggaagtgcgattttgaggaaattgaacgctgtatgacaaaagaagaggccgcacaggaagcgggacgctgcctcagatgcgatcattacggatatggaaatctgaaaggaggccgcgcagcaatatggtaacactgacaatagacaataaaaaaatcagcgtgccggaaggcactacgataatgaaagcggcggcgtccgtgggaattatgattccccatctgtgctatctggaaggaatcaatgaaatcagcgcctgtaaggtatgcgtggtggagatgcagggaaagaccaagctgataaccgcctgcaataatcctgtggaggaaggaatggtgctttacaccaattctcccaaggtaagggcagtcagaaggaccaatgtggagttgattctttcccagcataacagcaactgcgccacctgcgtgcgcagcggcaactgcaatctgcagaagctgtccaatgacctggggattattgatatcccttacaaaaaagaaattatggaaatgccctggaaccgggatttccctttaatccgcgattttggcaaatgcattaaatgtatgcgctgtgtgcagatatgcgacaaagtacaggacctgcatatctgggatgtgcagaatacaggctcaaggacgacggtggatgtatcacagaaccggataatagaggaatccgactgcagtatctgcggtcagtgcattacccattgtcccacaggcgctttgcgtgaaagggatgatacatcaaagattttccgcgcgctggctgattcggaaaccattacggtagtgcaggtggcgccggcagtgagagccgcctggggagaggccctggatatgccggcctatatggcgacggaaggccggatggtagccgcgctgaaaaaaataggttttgattatgtgtttgataccaatttctccgccgatctcactataatggaagaaggcaatgaactgctggcccggctggcggatccggaagaaaaaagatggcccatgttcacctcctgctgtccggcctgggtaaggttcatgaaatcccagtatccggaaatggcggatcatctttccactgccaaatccccccagcagatgttcggggcaattaccaagagctattttgcggagaagacgggagtggatccgaagaagatctgcagtatttccatcatgccctgtgtttccaaaaagatggaggccgtactgccggatatgtacagcgcgggagcgggagccgatgtggatattgttctgaccacccgtgaattcgcaagacttgtccgggcagaacatatcgctccggcgctgctcacggaagaagcgtttgactccccgctgggagagagtaccggagcaggcgtgattttcggtgtgaccggcggcgttatggaagcggcgctcaggactgcttattattgcgtggaaggagtgaatcctccgcctgacaccttttccgatgtgagaggatttgaaggccggaaggaagcttcctttaccctgggaggaaagaagctccgcacctgtacggtcagcgggcttaaaaatgccagggatttgatggaggatatacgctccggtgccgtacattatgattttgtggaagtgatggcatgtccgggaggctgtgtgggaggcggaggacagcctatcctcgacggtgtggaaatggcggatgtaagagggccgaagctatataagctggattcccaaaggccgctgcgcttttcccatgataatcctgagatcataaagctctatgaagaatacctggaaaaaccgttgggagaaaagtcccatcacctgcttcatacccacggataaactgcatttgacggcgtttcggaatttggaaaatattcttttttcaaattacttgacagcgtcggaaagtataccgtataataagaaggattcgtagaaggaaaggacaacacccttgtaccacgggtgttgtttttttgtgtgaaaagcttgaaataaaggaaggatttttgaatggaaataacgagataccaagacgcagcaattgattcccgcatacttcgtgccgtggaggaaatgggttttgtacagatgacacctatacaggagcaggcaattcccgtattattggaaagaaaagatgtaattggccaggcacagacaggaaccggaaagacagcggccttcggaatccctgttatacagaatacagatccggataacagaaacctgcaggcagtgattctgtgtcctaccagggagcttgcaattcaggcggcggatgagatgcaccggtttgccaaatatatgcatggagtcagaattctgcctatttacggagggcaggatattaaccgccagattaaggcattaaagagcggtgtccagattattgtcgggaccccgggacgtgttatggatcatatgcgccgccatacattgaagatggatcaggtgaatatggtagtcctggatgaagcggacgaaatgctgaacatgggcttccgtgaggatattgagactattcttcaggggattccctctgagcatcagacggcattattctcagcaacaatgcccaaacctattctggaaattacaaatacctatcagcaggatgcaacctatttgaaaatgaccagacaggaactgacaattccgctcgtaaagcagtattattaccgggttaacagccagatcaaggtggaggtaacaagccgccttctggattattacagtatacagagatcccttattttttgtaacaccaagagaatggtggatgaacttaccgaaacactgaagggcaaaggctatgcggcagagggcctgcatggtgatctttcacagaaccagagggatacggtgatgaatcgtttccgcggcggcaatctgcagatcctgatcgctacagatgtggcggccagaggtattgatgtggatgatgtggaagcggtatttaattatgacctccctcaggatattgaatattatgtgcatcgtatcggacgtaccggaagagcgggaagagaaggacgttcctttaccttcgtttccaacagggaaatgtaccgtctcagagatatcgaaaaaagctgtaagaccacgattcaggaaagaaaagttccgtctgcggcagatattgtttccataaaggcggaaagagcgcttcgtgcagccttcgatcttctggaaggggattcctttaagaacctgaccgagatggtggaaagaaagctggaagacagtgactacagcgctgcggagctggcggcggcattcctgaagcttcagatgggtgaagagcctcaggaaataccggagatggttcccgaaagaagaagaagctattccaggggcagccgtgacttcagtaatggacgtcaggacagagacggaaggaacagaagcagaggtgcgggaagttccgacggcaagcgtcagcgtttttctgaagacagaagcggtgagagacgcagataccgtgatacggcttccggaaaagacggcagaagcggacacaattacagttccggccgccgtcaggcagaaggcggagcccgcagggaaaaggacagacgtatcggttaattatatgggtaatgggaaagctgccatcgggaaatagcctgacggcagcttatttttttaagatatctttcataaacaggaaccgggacggaataccttttaaaaagagtttttgtttatggaggaaacttatgctgcaattaatgacagatggaattctcagatttctggcaaatcagccgaaagcctttgcccatgtgaaaggatcggaacactatccggatgtgcaggggcttgttaccttttatgatttaatggatgggacaattgtgatggtggatatttccgggctgccggatacgggtgaaccctgcggcgggaaattttatggatttcatatccatgaaggaacggcatgcaccgggaatgatacggatccctttgcggatgccggaacgcattataatccggataactgtccccatcctgcccatgcaggtgatatgcctgtgctggaagggaacaggggcagggcctggacggcattttatacggaacgctttacacccgaacaggtgaaggggaaaacggtgattatacattccatggccgatgattaccgatcccagccttccggtgattccggggaaaagatggcttgcggaactatccgatgaggatttatttgcatgggaaaaaaaggtagtgtataatacaagtcaaataccccgccgcaggcagcgggtattatgcgcctgttttcaatgaatacgaaatgaggaaaatatgaacgatagtaaaaaggaagagcgtttaaataagtatctggccgactgcgggatttgttcccgcagagaggcggatcggatgatagaagcgggaagagttattgtaaacggcgtccccgcacagatgggaatgcgtatttccgagatggatgacataacggtggacggccgtccgctggataaaaaggacagaaaggttgtccttgcttattataagccggtgggagttacctgtacggaaaaagataaatatgcggaaaagaccatacgtgatgccattgattatcctatccgggttacctatgcaggaaggctggacaaggattcggaaggacttcttctccttacaaatgacggtgatttgatcaatggcctgatgagggctgccaattaccatgaaaaagaatatctggtaagggtgaataagccgataacagatacctttctgcagaaaatggcggaaggtgtttttctgaaagagctcaatgtacagacccgtccctgccaggtggaaaaagaaggaaaatttgttttccggatcgtactcacccagggattgaacagacagatcaggcgaatgtgccgtgccctgggatttgacgctcagggaataaaacgggtgcgtgtggccaatattaccattgggaagctgaaaccgggaaattaccgtctgctgacagcagaggaattggatgaactctacgggcagctgaattcctgaaaaaatgtgacagacggagattaaaggagattcgcaggagatggataagactgcaagaatgaaggaactgattgcaatattaaatgaagcgtccagggcttattatgcccaggacagggaaattatgagcaattatgaatatgataagctgtatgatgaactcgtatccctggaggaagagacaggcactgttatggcgggaagccccacggtcagcgttggctacgaggcggttgacgaactgcctaaggagcggcatgaaagtcccatgctttccctgggaaaaacgaaaagcagggaagacctgagagactggctgggagaacagaagggactgctttcctggaagctggatggcctgacaattgtacttacctacagagacggacagctgtttaaggcggtaaccagaggaaacggggaaatcggggaagtgattaccggaaatgccagagtgtttgtgaacctccctctgtccataccctttaagggagaactggtgcttcgcggagaagcggttatcacatatgaggatttccggaaaataaatgaacagattgaggatgccgatgccagatacaaaaatccgaggaacctttgctccggttcggtgagacagctgaataatgagattaccgcacagagaaatgtccgcttttttgcatttgcgcttgtaaaggcggacgatgcggattttcagaattcccgaaaggaacagttcttatttctgcagaagctgggctttgaggttgtggaatttaaagaagtggacagcgataccattctgtccgctgtggaagagtttgaaaataaggtggcaggctattcggttccttcggatggtctggtattgatttatgatgatatcgcctatggcctttccctgggacggacggctaaattcccaagggattccatcgcgtttaagtgggcggatgaaacggcggaaaccacgctgcgtgagatagagtggagcgcgagcaggacgggactcattaatccggttgccatctttgacccggtggagctggagggaacaacggtgagccgtgccagtgtccataatatcagtattgtcagaggactgaagctgggaatcggtgaccgtataaccgtttataaggccaatatgataatcccgcagattgcggaaaacctcaccggcagcgatacgctgcccataccggatacctgcccggtgtgcggaggggcaacgaagatagagcaggtgaatgacgtacagtctctgtactgtaccaatccggactgtgatgccaaaaagctgaaggcttttacactttttgtgagccgcgacgccatgaatattgacgggctgtcggaagctacgttggaaaaattcctgggaagaggatatcttcatacgtttgcggatttgttccacctggggaaatatgaggaagagatcattgaaatggaagggttcggggaaaaatccttccggaatctcatggaaagcctggaaagagcaagaaaaaccacgctgcccagagtgatttacggtctcggaatagccaatatcggcctcgcgaatgccaaaatgctctgccgggaatatcatgatgatctggaacgcatgatgcaggccgatgtggaagaactgagtctgattgacggcatcggaggagtgattgcgggaaccttccatgattactggcagtctgaaacaaacagggaaaatatgaaaaagcttctgaaggagcttgagatagagcagatagaagtggacgaatcggcgctgaccctgcagggaaaggtttttgtagtaaccggaagcctggagcattttgacggcagaagcgcattgaaggagctgattgaaagcagaggaggaaaggtgacaggaagcgttaccggcaaaaccacatgtctgattaacaacgacatcgcgtccaattcctccaagaataaaaaggcaaaggaactggaagttcctatcgttacggaagaagattttatgagacaatatttggatatggaggtataagggatgccaattaaagtacaaagtgatctgcctgcaagggcgatattggaagatgagaacatttttgtcatggatgaatacagggcgcagcatcaggatatgcgccctcttcaaatctgcatccttaatctgatgcctgtgaagcaggatacggagcttcagctcctgcgctccctgtcgaatacgcctctgcaggttgatgtgactttcatgaagatgaacagccatacctcgctgaatacctcacccacgcatctgaataaattttataatacctttaatgaattgaaatcgcataagtatgacggccttataatcacaggggcacccgtggaacagatcccctttgaagaggtggattactggccggagctctgcgaaatcatggaatggtcaaagagccatgtcaccagcaccttccatatatgctggggagcccaggcgggtctttactatcatttcgggttaaataaggtcctgcttccggaaaagcttttcggtgtattttcccataaggtatccaatcggagagtcccgttggtaagaggctttgacgattatttttacataccgcacagccggcataccactgtgcccgccgaagaaatccatgcctgcagggaattgctggttatggcggaatcggaggaggccggcgtgcttctcgccatggccggagagggccggcagatttttgtaatggggcatccggaatatgacagatatacgctccataatgaatatatgcgtgataaagagaagaatctgcctattcaggttccgctcaattattatccggaggatgattgtacacagcgtccgaccatgctttggagatcccattgtaatgatctgtatactaactggctgaattactatgtttaccaggcaacgccttacgatctgggtgaaatataggatttgccggggaaatagctggtttgttgcagggtagtgtggcttattggaagattttgtgaggtggttgtatatactatattgatgtacgcaaaaacgtacgatataatatagtcagaaggtgtgataaatatcataacgcttaatgcgacaaatgcaagaaaaaacatttatcaactgataacggacgtaaatatgaattctgatccagttacgattactggaaaaaatggaaataatgctgtgttgatttccgaagctgattggaaaaatattcaggagacgatttatcttaattctgtactaggacttgcagaatctattattgctggtagcaaagaacctatcgatgaatgtaaagagtatgcagagggcgaagaatggtaaggtacagggttgttttttctaaataggcggagaaagataaaagactggtaaaacagtctggttacgaacagaaagtaaaagattatattgaataagttgcaagaagaccctttctatcctcctgtagacggtttacaggggaatttaaagggcttcttctttaagagaatctttttgacattttgaaaattcttaataaataaatgacagctttcttcatcagaagaagctgccacttaatcttaatttttgtagtttaaggctctggctgatgcattctccttattccatttcgctcaccggttcatcggcccccgcggtgctgtcttcggcatcttccttaataacagacacacttccttttgcctttttccctgtcacagaaacagtataggtgccatcctcctgtatgactacctgaaaggctgaggttggaatatcggtgccttcatatatcggatcttcctcgcctttttgaagctgaatatcaacacttcccgactggctgacaacatcaaaacggagaatatcacccaccgccaatttcaatttctgggaatctgtcatattcaatacatcatactgcataataagctggctttcgtttcctgtacggctgccgtcaaatttcgtaaaattacaggcggaaaaggaaactactgataccagtatcaaaatagaagtaaaaatatttttcattatgtctgccacctttcgttatctgtatccattctattcacgggtaatcctctgttttttcaaacaaatctttttgattatactatattcttccatgtttcttccatgttttcatagccatcaggcagaagatgttgccgcctgcatactctgtgaggtataatgaagtaaagcacatgcctgcggctgtacatgaaaatagcagagaaggaatacataacatgataaacagagaagacatgctggaactgaccaggcggatgacccttgcccggacatctttttcaagaatagccggatgctatatagataaggatggtgactttgaggggagcttcaacacgaacttcctgaagctgtccgcagcggaaaaaacgaaaaagctgaagctggcaaaggcgattccctattcagaaacaaatgtaaaccttaagaaatacgaaatcccccagagtatgcagaagccggggagcatgtggcagctgctcatgacaatgaatgagtgcggtctgaaaaatgatgccctgatggatacattttatgatattgtgatggaaagctatcgttcggattcggagtatgccattctggttttccatggccgttatgatatccctttgaaggccgctgataaagtggggctgtgggagtcggaggaggtttttgaatatatgatttgtgccatttgtccgttggagggagaatatgagccgggggatccggagtgtggatttttatttccggcgtttacggacagaagcagggacttagaccatatagctgtttttcaggcggatacggatcgtccgcatgatgaaatattgaagattttagggataagccggtaaaaaggatgaggtaagaatagggatttacccgggaggtttgttatgaaaagatatttttctattattattgtattcgtgcttatgctgactctcatggcctgcggccgtacggaaataccggaagtaacagagacagatgcgatggaaacaacagaaacaggtaagatggaaaccgctcctggcactgtggaagaaagtattccagcagaagcctctttgcaggaaacggaggaagaggagattcctttccttacaagcgcgccgaagctttacctgtccgatgccttatccagcacgatggaccggattgaactgcagtccggaaattattcatggagctatctggacaatggggaaacgacaagtatggtggcctgcggtgtccatcctctggataaaggggcaggcggtgaggaaaaagtgaaactgccggattataacgggattgacttcgtgtcttatcttgtctcaagtgaagcgtctcccgacagccttctggtcagtgaatgggatgctgccgatgaaggaaatgttgaggcaaagccgaattatgaaaaggtctatgaggaagccttcttcatagaagtaaagccggataaaatatatgagattacagcggtatggaaggatgaaaagctggaagaaagaggattcagcggtgaggcctcttatgtattgaagacggagtaagcaaatatcacagtgttgttcgaagagacggctgtttccccacagccgtcttttgctgtacaaaagactattgcgaagaatgcagaaaggatttttataacggtactatttaaaaatacagttatatctgatggacatcttatttataactacagaaaaaatgtactaaaagtacttggtacatatattttgtacaaattaaataataaacattgaaaaacaccggataacaatatataataagtgcataaataacagcttcgacaaaagtgatagcgctgtcatatagtcaaaatgattatttttattgaccgaacaaaagaaataatggttgaaatatttgctgtacagacattcaaaaagaaggcggacaagcaatatagatacaacaaatatgcaataaagaagatgcgaaaagtaagtaaactcaaaaagaaactgttaattcaacaaagtaaaggaggaaactggttatgaagagactgggagctgtactattgtcagcagctatggttctgtcgcttacagcatgtgggggggggggtaaaaactgatgcacctgctgcctccgaaccggctaaggaatccgcttctcctgaggctgcgcctgcggaaggtgctgcggcggaaggtacggatatcagcggaagtacgctggaggttgcggttacttacaccggtgatcaggcgaccacgttccagggtctggtagacaagtttgaagaagagtatggatgtacggttaatgtagccgagtatggtacggattatgaaaacaccttaaaaacacgtatggcggcaaatgagcttcccgatgtattccagacacatggatggtccatcctgcgttataaggaatacctgatgaatctgcaggatcagccctgggtttcggattatgatgattccgcgctgggcgttatccaggatgatgacggagcgatttatgtcctgatgatttccgaactgattaacggaacattggtaaatacggatgtttgtgacgcggcaggagtggatccttataccatccatacatgggatgatttcacagaggcatgtgagaaggtgaaagcgagcggaactacccctatctgtgtgctttccaatcccggactccttgcaaactatgcgggaacctttgtgagctatgaaggagaaatgttccaggattctgcggctatgctggacggttcttttgactggcaggactacaaggcttctctgattaagtatatggcaggctggattgaatccggctattacttcgatgatatcctcacactggtggatactgacctgaccgaacgttttgcagcaggcaagggcgcgttctgtttgggaaatgacccttccgtaatgcttacctgccttactcttaatccggatgccaactttattttccttccctcttttgcatcaaaagaaggcggtaaagagcatgttggtattggagaaggagatacctttggtatttggaaagacacaaagaatgtggatgcagccaaactgttcttagagtatatggcacgtccggaggtagcgaaagaaatgaatgccgcaacaggcaaaatcagctgtctgaaatccaccatggatattgatgatggttatggtctgaaggtattccaggatatgaaagagaaatgtgcggactgtgatattttctatgagaacctttgggacagacagtatatgccgtccggtatgtggccgattttcggaaatgccagcaatatgctttttgatgaccccagtgaaaaaggccaggatgcggtaattgaatatctgcttgagaactatcaggatttgtatgaagctgctaaagaaggctgaaatagttaaacagagagaacaactgaaagaaatctgaaacgatggtggggtggcaatgccatctcacctgttttgataaagggggttttattttgaaaaaaagaaagtggatctatctctctttgactattccggctctggccttaatgattttatttattgcagctcctctggtaaatgcgattcggatatccttctttaagtggaatggatattcgcagaacatgcgctggtacggcctgaagaattttgcgaatctgttcaaagatgatttgttctggagagcgactctgaatacatttatttatggctttggctccactcttgtccagaatgtaggcggccttgcagccgcattgtttctgaataacaagttcaagggcagaaatggtgtacgagttatcctgtatatgcctatcatgatttccgcatttattatggggcagatattatattattttgtacaggcagaaggcggcgtatttaatgaactgttaggccttatcggcattcctgcggtttattggatgaaaacaggcctttcctccacacttatgattaccctcgccaattcctggcagtatatggggctttgtatgatcatttatctggcaggccttcagaatattccttccatgtataaggaagcggcaaagctggacggcgcgaacagggtaaaagaatttgtccacgtaacacttcccctgctgattccctccatcacaacagcagtggtaaccaacctgataggcggttttaagttgtttgatgccattgtggcgatgtcaaacggcggccccaacagaaagtccatgtccctatccttctatatctcccagctgtattttaatgatgagaaggcgggatatgcttctgcagtgggtatcatgactttctttatcattatgattgtagctctgcctgtcaacgcttatctgcgtaagaaggaggtggagtattgatggaaggaaagcttaagaaaagcaaggggccgaatacccgctccgtatggtggtgctattttgtggcggtattgcttatactgatttatctgctgcctatttatatcatgcttaacctgtcatttcgtacgctgcaggatttgggatcgaaattgtcccttccggcggcctggaatctgcaaaactacgcagatgtattaaagagcggtgatttatggctgggttttaagaactccattattcttgtggtggaaacggtaacgcttgaaatcgtgctcgctgcgctggcggcctatgggcttgcaagaagcagcggcaggctttcggaatcgatccgtaacctgaatatgggtatcatgatgattcccagtgtggcgctgctggttggtacatacggcctgatggttaaattccatatgaccaataccctttacgggctggctctgctgtccgcggcaggagggatcccgggaaccatgtttatgtatgtcaactttgtggtttccattcccacggcgctggatgaggcggccgccattgatggcgcaggcgtaatccgtaccttcacccagatcattatgcctcagctgaaggccgtgaccgttaccagaattattatgtctgcaacaggctgctggaataattacctgatgcccatgtacctgctgcaggataagtcgaaattcaccattatccttgtgatcaagtcggcatttaacaggacaaatggcgtaggaaatctgcccaaggcctgtgcgacgtgtgcgctggggctgctgcccgttattctgctttatctgttccttcagaaatatattatagaagggcagattgacagttccgtgaaataaatacaggaaggaaaaggaaccatgaaactatataaacgaaagctgcatgatcccgcgcctctggggcaggcagatccctatatgatgaaagcctcaaacggtaaatattatatttatgccaccggtccttccggcccgcagctctacagcagcgacagcctgatggaaggctgggaatacagaggatgctgtctggacatgacaggacagaaaaattgctgggctccctgtgtggtggagctcggcgggaaatattatatgtattactcaagcatggacgaggatgatgaagatgagcacggccagactatgcgggttgcagtctcggattctccggaaggggaattccggctggttaaaaatctgcttccgcctttttccatcgatccccatgcggtcgtcactccttccggaatgtattttttctattgtgtaaatgaatatgaggcggagagagtagggacggtggtaatgtgcgataaaatgacggatccccttacgttggagggcaatccggtctgcgtgatccgacccactctggatgaggaaatatatcaaagggatcgctttaaggaaggacagcactggcatactattgagggcgccttttatttctgcgtcggaaatacccattatttgatgtattccggcgcctgccaccagaatcccacttatttcatcggctacagtgtggcccatggagctccggatgcggatttgagaactcttgactggaaaaagtatcccgatgataacacctattcgcctctgctttccaaaaatgattttgtagaaggcatgggacacaacagcgtgatctttgataacgggaaatgctatattgtatatcatggacgggactatggaagtgaagccttccgtaatgattcgggtataccggaagatacccggtcagccagaattgatgaaatgaaaatagacggagatgtcttatccgtagagcctacgagataatatcagaaaaagccggcgtggagccggctttttccatttaaaccgcagagatatcattatcctcttcataattgatgtactttttgaacagaggctcctgtatgaaagaggagagccagaaggaacccgcaggaatgatgaacagaagaggcggataataaatcgccagctccacagcaaaaacaaatatacatataagaaggaaattcttaaagggatgccggaaggtaagcctgacaatcagggtaaacagttcacgccggttcagccggaaacgtccggaaagggcaaacccatgaatctgtgcggccagacagacaagaatggaaaacacggaaaaaaatacatatatgccggcaatgatactgtccggattctgccagcatacataacaggttgcgccgaataagacatagacaagaacaagcagtacagtaaagggaaatgtctgcctcaggctgcctttgaaggagtccctgaagtcggcaaaagcgtatccccggttctgccggataacctttaccgcggtatggtaaagggctgcgctggaggctcccagagtgagtaagggaaggctgcagaggcaccacagcacgctgagcaccaccatatcggccgctttattcaatattgtcataagtgtactgtcctgattaaacataggggtttcctttccgggccggtcagctgttttcgtattccactttcataacgatatcctgggcataatcaccgaagtgcttgccgaacaggttcatgccgcctatatgttggctgtcatcggctaccttcagtatgaaggagaaatagtaattatccagcaggcccaggctttctatggtttcatcggagaccttctggttgtccatgtaacagccgtgatgggtcacgtgaatttttttgtactctccaaactgtgtgttggattcgctccaccagctgggattatatattccctttcttccgccgtaatctcctttggtaagaaaagtgaccacctttttatgattgagttcaaaggtgatatcagaaggccagttattgttatagccgggagcctctgagcatgcctcaaaggaaaattcgatttgcgccggtttatcctgaagcagggaatagttggagaactggtattccagatacccctttgtaaaccacaggagagaagcgtccgtgcggtcgggagagtaaaagccataaggagtgtcttcgtaataaagataggagacagcggaagcgatgccgcagggcggtgatatttcacagttgcagtaatggccgatgggcatgtttacaaacacaggaggcttgcgggtgattttgctcacatgggcaaagacgtccagggagacattggcggtcttaataccgcacaatttctgagaaccgcgcatgcccggtttggggatgacggttatcaggttggcttccttcagggttttgatatggagacacatggaggacatgggaagataaaaagcttccgcaagctcgctgatagtcatggatttggctaccagacatttcagtatttccagacgggtttccgatgacagggccctgcatattttggcagtggtttccgtatcggacaaatccatgacgatgtcttttttatttttgatttcttcggaatgttttgcttccatgttcataggcagtgctcctttaaatgagaaggaagcggcaggcaggactctgctcctgcgccgtttgttgatataaacaaagtataaaaggaaaagatgtttattgcaagctataattacattaaaaatgtattaaaagaggcttttgcatataaaatgtatagtattaatttaatatattgaaaattaatgtgtaaattatataatcaaagtatcgatgggtacaaataaaatggaaaagaaagccggtgaaaaaattgaatattttatggatctgtacggatcagcagagggcggataccctgggctgtatgggaaatgaatgggtctgcacgcccaatctggacaggctggcagccgaaggggtggtgttcgagaatgcctattcccaaagtcctgtctgtgcgcccagcaggggaagctttctcacagggcgttatccgagaacctgcggccccaggcagaatggacaggatatagacgccggagaaagattgtttcccaaaatgctggctgacagaggatattactgcggactggccgggaagctgcatctgtccgcctgccatccggatacgggaagactggaagaaccgcggattgatgacgggtatcatgtgttcagatggtcacaccacccgcagccccatcatggcacaaactggccctccaatgcttataatcagttccttctgcagaacggaagggattatatcactcccgacagggaggattgtccctatgtacagacaggggtggaggaaaaatggcatcagactgcctggtgtgcggatgaagctattgcattcatggaaacggcccggacatacggaaaggattggatgttttccctgaattgctttgatccgcatcatccctttgatccgcccgccgattatctggaacgctatcttgataagctggaacagcttcccctgcccaattatgaagagggcgagcttgctgaaaagccggttttccagcaaaaggatcatgagggggcttatgataccaaaggttattacatgtatgacaacatgaacgatcatgatcacaggcttatcaaagccgcttactgggctatggtggatctgattgacaagcaggtcggcaggctgcttgattacctggataagtccgggcagagggaggatacgctgattttgttccactcggatcatggggagaatctgggggatcacggcatgtacctgaaggggccttatttctatgaaaataatgtccatgtgccgctgattatcagctggcccgccagaataccgggagggcgcagaagcagggcactggtggagctcaccgatttggctcccacattgtgtgaagcggcagggctccccgtctttgaaggttttcagggaaaatccttttggaagctgctcacaggggaaacggacctgcatactcacagaagcagtgtttacagcgagtattataacagcaatatcaaccacagggatccgctggccttcgccaccatggtatgtgacggacgctacaagctggtcagggtgcatggcgatatggggaaaacggcaggcggagaactgtatgatctggaggaaaagccgttggagaggaaaaaccattatcaggatcccggactggcggaggtgaaaatgcgcctcctggaaacgatgtgcgaccggatggcgcagacctgcgatcccctcccggtgaggaaggcctgctggtgagagaagcacagaaacaaaagtaacagtaaatgggtgaccgcggaaacggaagaaggttccggcggagaagaggaggattgtatgggattagtaagagtaagggatattttaaaaatggcggatgaaaatcgttttgctgccgccgctattgatgtttttgatttccagtctgccgaatgggtggtgaaggcggcggaaagggaacaggtgccggtattgctgatgttttatccggatatgagttccttcatccctttcagtactatggcgggcatcgccgtggatctggcaaaacaggcatccgtgccggtaggagtccatctggatcacggcaaatcctatgatgtggcggtaggaggaattgcggctggctttccttccatcatgtacgatggctccgcacggccctttgaggaaaatctggaggttacggccagcgtggtaaagtgtgcccatatattgggaattgatgtggaagcggagctgggaacggtggggcagggaagccggaaggaggacttctgcaacgaggagctatataccaagccggagatggcgaaggattttgtggaaaggacgcatgtggattccctggccgttgccatcggaaacagccacggacattatgtatgtgagcctcatctggatatcagaagattggatgaaattaacaaaaccattgatgtgccgctggtgcttcatggcggttccggcattcctgcggagcagatgattgagtcggtcaaatacggaatcaacaaagtgaacatcggtacggaattctttgaaaaatgtaaaaactgtgtggcggcccacatgggagaggatggttttattctggatcattacaaagaagcaggggaagaggttattgaatttgtgagaggccggatcgccagaattaatccttatcattttaccttgtagaatgcgggaagagagggcgttttatggatatggaaacaaacagggccatggaggtggtcggtattggggtaccctattatgacatggtgatcaatgtgagcaaaatgcccgggctggatggggccgccggcgccaacgaagcattttaccagggaggaggaaaggtggccacggccatggctgcggcggcaaggctgggacggcgtgccggtatcatcgccaaggtaggggagaatcacagaggaagatttgttatcgaagatttccggtacaatggcgtggatacgtcggcggtgatcgtggatgcgccgggaacatcgagccccttctgcctttccctgtcggaagaggagcataaaaccagaattttcatcggcaaggaggggacggccggggaactgcagccggaagagatcgattattcctatctgggaaaggcgaagtatctgcatctggaaaacggaaggtctgccagtgaggcggcggcccgtttcgcaaaggaacacgggatcgtaaccgtgatggatgcggacaattatcaggaggggattgtaaagctgcttcccttgctggatgtatttatcgcttccgagtttttctaccgggatatgttcggggagctggattatgaagcaggctgcaggaagctgatggcagcaggcccgtctacagtaatcgtgactctgggaagcaggggcagcgtggggctgacggaacaggacgggttctttaagacggaaagctttcaggtgccggtgagggatacgacaggagcgggggacgtattccacggagcctatatcgtggggctgctggaagggatgaatgcgccggaatgcgccaggtttgccagtgcggtttctgcgattaagtgtacctgctttggcggcaggacggggattccggacagaaagacagtggcggaatttctggaaaccggggttatcgatgacacgcaggcacaggagcgtctggcgtattacagaaataacctttaacaggaaaattcgtgaataattaatttgcgtaaaaacgatcatgggggtaaaataaactatgaagaacaggaacaagcagcttagggttggactggtccccacacggagggaggcctttgccaatgaaaccacgacaaagcagaagaaagcgatagtggaaaggttccgctggctggctgcggaactggattttgagatggtggatattgaagatattaatgaggaaggcatgctgatgacctaccgggatgtggaagccgcctatgacaagctgaccgcagccaaagtggatgccctgatcttcccgcactgcaacttcggccaggaggaagcggtgggcaggcttgcgaaggacatgaatctgccggtcctcatctgggggccacgcgacgggtatcccaacgggctggaatggcgtccgacggacagccagtgcggcatgtttgccacaaccaagcttctcatgcattatggagttactttttcttacatagaaaactgtgagctggaaagtgatatcctcagggaggaactggccgatttcctggctgcggcaaacgtggtgaaggcgttccgcgccctgcgtattgcgaggatcagcagcaggccgaaggaattcctgagtgttatggtaaatgaagcggagcttctggaaaagtacgatattgaaattgtgccgggagagccgacggtgattctggatcgtgtggatcgtattctggcggaggacagggatcgcatggaggagcttctgaagagcctgacggatgcggggctggatatcagcgcactgggggaaaacaggtatcctctggcggccattgaactggcgctcctggatttcgcggaggataatgactgtaacgccctttcctgtgagtgctggaatctgttccggaagaaatacggggtttcgccctgctttatcctgggggatctgaatgacagaggccttccggcagcctgtgaaaatgatgtccacgcagcaataacctccgtgatggctgttgcagccgccagatataaaactccctcttttgtggcggatctgacgatccggcatccggagaatgataacgcggaactgctgtggcactgcggatccttcgcgaaggctctgaagaaagaaggggcgaagggctgtgtcatccgggaaggaaagggattctatgaactggaaggcggtcctgttaccgtgctgcggtttgacggaaaccacggggaatattatatgtttgccggagaagcaaaaggggtggacggtcctgttaccaacggaaactatctctggattgagactgataactgggttaagtgggaaaagaaattcattttcggcccttatatccatcatgtggtgggaattcacggaagctattccggcattattcaggaagcgtgccgctatctgggaatacggatagatctgcctgacatgcctaaccagtactgacaagcggggaatatagatgagaggcgataaaaagaccatccggattttctggacactgtttgcctttaatgccttattttacataccgggggccaccttcggcgcctatatcggcgtatattacaggtcccggggaatggatgtttctcaaatcggccttctttccgccatcgggccgctgctggctctggtcatgcagcccctttggggtgtggtttccgacaggaagggcaggcatatgacagttctgcgactggccctggtgggttcggcggcgggcgtcctgtgctattaccgggcggatacctttgcgctgtttgccgtatgtgtgctcatttacagcttttttaactgtgcggtagggcctatcggggattccatcgtggtggatatggcgcaggaaaacggcctgaaattttcttccatccgaatgggagggacgctggcttatgcggtggtggttatttttgcgggaatgtacctgaaaaccaatcccaccgcatccttcgggatcacggccgccgcatgggcgatcatgctgatcataacacggttcatgaacggtgaggtaaagacccataagtgtgagaagcaggcgggtattctgacagtcctgaaaaataaaaaaatcctgtttgttcttttttacgcctgtgttttccagattgtgctgggctgctacggctccttcctgggtctggtagtgacggacatggggtatgataacgcggttataggccggctgatgtgcgtttctgccctcggtgaaataccggtcctcctctgtattggctacttatcaagaaaaatccgtattgaatatctgctgctcattgcaggggccgctatgaccgtaaggatctggctgcccctgacagggagcatagccgggatttttctggggcagtccctgcagggagtgacctatatgatcatgtattacagctgtgtgatgttcatgaacgagaatttatccaaggagctgcatggtacgggccagtctctgttctatatggttcagacgggacttgcctgtaccttcagcaatattgtagggggatggctgggagggaaaatcggccttcttaaaacctattttctttatggcctgattctgctcttcgtcacagtgctttgcgcctttgtgctgaggagccattttcataagaaaaaacaagaacaaaaggaggcggaatttttatgagtgaaacgggatcattgctgtcagggcttaccagcctggcagacgcaaagacaagatcgatcagcccggaaaatttccacggggaaaaaggcagaggcggaatggcggtggaagggaccggaaaggaatgtgccaggcagctggggcagggatggaaaatttccccttcggttgaaatcgcgggaaaagaacttctggtgctggcggatatcgagggaagcggcatcatccagcatatctggctgacctgtccccatgaagactggcgttccctgattctgcggatgtattgggacgaggaggagaatccttccatagaggttcctctgggtgatttcttctgcatgggctggtgtgagcccgggcttctgcagtccattccggtatgtgtcaatcccaacgggggaatgaattgttattggcagatgcctttccgcaaaggggcacggattacgctggaaaacctgacggataaaaagagtgtggtttattatcagatcacctattcccaaacccatgtggcggaggatgctccctatttccatgcccagttttcaagagataacccgctggaatataagaagaaccatgtgattcttcagggggcggaggggagaggccagtatgtgggcacctatctcgcatggggagtgaacagcaaccggtggtggggagaaggggaaatcaagtttttcatggacggcgacaaagaatttcccaccatctgcggaacaggtacggaggattatatcggcggcgcctggaattttgagtatcccaaaggggaatactgccggttttcaagtccttattccggcctgcatcagatcatccgtccggatggcctgtatagttcccagcagcgcttcggtatgtaccgttttcatctgacggatcccgtccggtttgaccaggaccttcatgtggagatccaggctctgggatggcggagcgaggggcgttaccttcctctgcaggacgatatcgcatcggtgggctactggtatcagacggaacctcacaggccgcttcctccgctgccggatgtcgatgaactggaagtgaattgagtatggggaaaatacgaatacacctggatacggatctgggggcggatgtggatgatttatgcgcattggcctggctgatgcggaatccggatatagaaataaccggtatcaccacctgtctggagcagggaggcgtgagagagacttatgtgaaagatatcctgcggcgtttcgggcagggggaaaggatacctgttgccggaggggcggattacacctggtcgggagaaaaggactatggctttacttttgcccatgaggaaaggatgttcgggcaacgttatcccaggaaggaggattaccgttcccgggcggttcctttaatacgggacagcctggaaaaaggggctgtggtggtagccatcgggccgctgaccaatatcgcggaatttgaccggagttatccgggccggctgaacagggataatttattcattatgggaggctgcctgcaccgtcctgaaaagggatggcctcagtgggggccttccagtgactggaacctgcatatggataagaaagcggcgcagtgggtgtttaacaggatttcctttaccatggcagaggtggccgccactctgaaaacctatctgtcggaaagggactgcagggaactggacaagggcgacgggctttgccgtctgctcgcccttcaggccagggaatggaggcgggtatccggttttatagaggagcaggcggcacagtgcgcatgcctgccggaggatctgtgcaattttcattatgatccgctgacagtggcggttgccgccggcttcgggctggttcgcagtgaggaagtcaggatccgctttgaggcggatgcaggaggagaagagtattcccttcaggaggctgcggagggaaatccggtgcgggcagttacggatgtggacggagaggcctttaacaggtattggcttgaaggggtgcttggcagcgcttaaaagggttaatcggaatgagaaaagggaggttttatggggacatttacatattacaaagacaggcagcggaccatatcctttccggtagggggattgggatccggctgtatcggaattgcgggaaacggctgtctgatagactggcaggtttataacaggcccgcaatggggacgagaaacggatatagccattttgcgatcaaggcgcaggatgaaacagggctgctggatgcccgggttcttgtttcggatctggaaaagccctatatgggtcaggtggatgaaaaaacaatgctgggaatgccgcatttccgggagctggtgtttgagggaagatatcctgcggccaagctgtccttcctggatgaaagatttccgggaaaagtcacgctccggtattataatccgtttattcccttaaatgataaagattccagcattcccgggctgtttgcggatattatcgtggagaatacgtcggatcatcccatccgttatacagcggcaggggtgataaccaatcccaataagggaaccaacacaagcaatcattattttgaggacaaagggatccggggaatccgttttgcaacggatgggatggatgaacgggatgcggggtacagcgattttaccctggcgacggattcagaagaaggggactgccaggagtattggttccgcggaaactggcgggatcatgtggaaacctactggcgggagttcgcctcagaacagccgcttaaaaacagacgttatgagacagggcttccggattataaggatacgggaatgctctgtgccgtacaggatatcggtccgggggagaagaaggaatttcattatgtcctcacctggaatgtgccgaactgtaataattattggagcggcctggatatcagtacctccaatatccattatgatgtgtgcgaccgtacgccctggaagaattattatgcggtgctttttgcggattccggggccagcgcatcctacggacttgaaaaccgggcgcgcctttgggaagaaacgaagagttttatggacgcggtttacagcaccaccattccggaggaggctctggatgccgttacggccaatctggcgatccttcgttcgcctacctgcctgcggctggaggatggttccttttacggatgggaaggctgctttgacgatgtgggaagctgcgaggggacctgtacccatgtgtggaattacgcttatgcgctgccttttcttttccctgccctggcacggagcatacgggatctggaattcacttacagccagcaggatgacggcggggtggaattccgtctccgcctgcctctcggaagcacgggaaagagattccattcctgtgtggatggacagctggggagcgttatgctgacctacagagattacaaaatatccggtgacagagagtggctggaaggaaaatgggaatctgttaagaaagccattgcctatgcctggtccgaagaaaatccggatgcctgggatcggaaaaaacagggagtgctggacggaaggcagcaccataccctggatatggagctgttcggccccaatgcctggcttcagggattttatgtgggtgcgcttgaggcagcggcggaaatggctgccatattgggagacggggaagcggaggcggagtacagagccctggccgccggaggaaaagcgtatttgaacaaggaattgttcaatggagaatatttttaccagaagatagatgtgtgcgaccgttctgcagtggatcgatttaacgcctcaaaagagtactggaatgaagaaaaggggcagatcaaatatcagatcgcggaagggtgcggaatcgatcaggttcttgcgcagtggcatggaaatctgtgcggactgcctgagatatttgaaaaggaaaaggtgcgtaaggcacttgcttccatcttccgctataattacaaaccggctttgggggatatttataacccatggcgaatttttgccatcgatgaagaaagcggcgcaatcatgtgcgaatggccggagggcacggataaacctgccatccccctgacctatgcccaggaatgtatggacggcatgcagtatcaggcggcggcccatatgattcaggagggaatgacggaagagggagagacgattgtcagagcggtgagaggaaaatacaggggagataaccggaatccatggtgcgagatcgaatgcggcagctactatgcacgctccatggcaagctatgcgctgctgctttcctacagcggctttgtgtatgatgcagctgcgggtattatgggattccgcccggtaatcaaaagcaaagaggaggatttctccagcttctggtccatgggcagcggatggggtaccgtccgttacaggaaggatgggagcatatggcttgaaataatccggggaagcctggaactgaagcggtttgtttatggaaacgggacagaggtgacagcggtatacgcggacgggaaagaagttcctttcatgcatgaaaaggaagcagtgggattcccggagaaaatcagaatacaaaagagtctggagctgaaggcggattaatccgccttcatttctattctctggcctgtctcaaaagaacggattgctccgtaggccagctccagggcgcgcaggccccgtctggcaggaaccggcggcttttgcccagcgagaagcgccggaatgagcgcgtccagatgccggtccagattccggccgaagctgcgcagatcgtcttcaaagaatccggcctgccaggtttctgccatatcactgttggtggactggaaggaataggagcgcacattatcctctatcaggattcttccgtccgtgcctccgatttccacaagctgggacaggcggttatgctcgttagcgtccagtgtggcgaggaaggatcccacggctccgttttggaaacgcagggccagggtaaagctggaaaagctgtttcgtccgccattatctgtcatttccgccatacaggagcggatggggccgcagagatgctccagaagatccaggccgtggcactgtgcttcgatgagattcagataaggatgatccaggtaaggggtatcccatccatggccgaaacgccagtgggcgaataccggccgtcccaggcggccttcatcgatggcctgtttggctttcagacagggaatgctgtagcgctgattgaaatctatggcgtaaaagagatttttttcttccgcctttgcaaccaaagctcttgcttcctccagcttataggcgataggcttttccgacagaagaggaataccggcttcaatgattgccattgtggtttcaaaggtatgctgggcgggaagacagagagagacaaaatccggtttttccttttccagcagttccgggacggaaagataaaaaggcaccttgaactcggcggctctttttgccgtccgttcctgtgtacgcccggcgattgccacaagctctgtatcgctgcgtccggaaaacgcccttgcatgctgatagccccagccgcctgcaccgatgactgctacgcgtaattttttctgttccatatatgactcctttccttatgcctgaaagaaacagggctgagttgttgttacaggaccatccaccaccagaatatccggtccgttgtcctgttcttcaaaacggatacgatccacacaaaggcgtcgggggcccattttcgttaaatcataatgttggtggtaaatgatgaacatgtctttcttgtcgggggaccaggtaatgcagtgatggcccacgccatgtacgttttcattggaacgaagaatcggattgttttcatatttcctgaatcctcccaggggagaatcggaaacagcgtagccggatccataatcggacaggcagtggctgccggaataggtgagataatacagccctttgtgcaggagcatataaggcgcttcatttaccggccactggatgcattcccagggagtgtccggaaccagaagccgggtcagggtttcctcccggatccccagcagatcatcggtcattttcgctccccagatctggttggaatcaaagaaacggacgaaatacagataccaggtgccgtccgcatcctgaaaaaagtggctgtcaatttctttggtatcttcgtgcagaggcttcttcacctcctgtacaaaggggccgaggggagaacggcttgtggagatacacaaatgctcctccacggagtaggaaagataaaagaggccgttggtatagatgatatccggcgcccagaactgcttttctccccaggaatcgcaggctttcagcgccataccggcatcgtgccagcggatgagatcctttgaggtataaaccttgaagcccatttcggaatcatccttcatgtcggtgttggtggcataaagataataggttccttcataatagatgacgtccggatcggcacagccgtccagaaccggattggtgaacatgttttcttccataaaaaatacctcccatagtaagccgcgctttcagattaacttgacggagcgcagactgccgctgtctctattttatcaaattctgcggggagatgatatggttttgccgtgttccaataattttatatccatcagccgaattaactacaaaaaaatgaaaggagtaattaaaaagtctccttaataattactgtaatttatggtatgataggaaacagaaagcaggcatgatattcctgcgcaaaagcacagggattcccggagaagcaggttcggagagggaatccggaatcgaggccggaatgtatgaatgtgcggaagcggtctatcagaacgaaatctggaaggctgcctctttaaaggatgagaatggaaattataagcaggaactgcgtctgaagatgaaaaaggaaagtcaaaagcattgttttacctgtccggaatgtggggaaagcctgatactgaatgcagggaatatcaggcagccttatttcagccactatgcaggcagtgattgtgtgcttaccagcaaagaacaggcggagagaaatcagctgatgaggcaggccatgcttttgctggcccaaagcagcttcccggatgccgaaatccgggagtatgctcttttgaaggggaatatgcgcagccagcttctcataatgctgcctgacagtaaaatcgcgctgaattatgtatccgattttgtgaagcttggcaggctggaagataaaattgcctgtatgaaggaaaaaggaatggttccggtctggttcacgcccttcaggatatcgggcagagaaaaactgacgacagccgaatatctgatcagcgcggagcagccggttcttaaaagcattgactggttaaataagcttatttgtatgaaggaatatgatgcggacacggataacatattgtgggaagaatgctattcctttgcggaactgcggctggacgaagagggggaattcgtctgccgggaacagatagagcctgatgaaagaaaattacagcagctcaggcagcaggaaaagctggaagagaagctggaggaagaaaggcggctcaggctggagtgcgggagaaaagcggcagtctgtctgttcagacagaaagaagcctcttctgcggtgtatgaaccggatcaggtggtgctgcggatctcaaaggaagaatacatgcagcaggaatatgcgtatggacaggatttctttatggaatcctttgatgagtattgggttttgaagaagctgaaagggggaagccgggaacggcgtgcagcggcggcagtcagggaaagattcctggaatatgcggattatgagctgcagtatgaacggaagggggaggagaaaggacttttcttaggaaaggttcttcagattctggaggaggtccgcgacagcagggaatggctggccgcggggagttaacagatacagaatacattccgccttccgggaatagcaggaaggaaatattttgaggacacaggagaaaaccacctatggcaaccatcaaacaaatagcggaagagctgggaataagccctaccaccgtatcgaatgtaattaatggccgtacaggcaaaatgtcggcggaaaccagagagaagatagaagaggccctgtgtaagtatcactatgaaacggcagggaaaagcggcggtgcggccgcggaagaaaatatgattgctgttggcttctgcatggggcggaacaagaatgtcatgacggatcccttctgcggtgagcttttgggagccattcagaaggccgtaaagtcctatggcagatatattgttctggatgtgccggaaacggaagaggatttaatccgtctgtgcgctccttggaatatcgacggcgcgatcgtactgggatggaacccggagcagtgcgctaggcttcagcaaaaaatcaacaagccccttgtttttattgattcctgttttgaagatatggaagcggagcattccatggaaacagagtattccatggaagcatatgataatatcggtctgcaggattatgaaggggcctttgagctgatatcctatctgcttcgtctcggacaccgtaacatcgcatttttcagcgatcaggagccgcctatggccagcaaccgggaacggttcagaggatatcaggatgcgctgaaagccttcggtgtccctttttcccgggaagacttttatttccttccggagaataagacgatgcgtcatgaggttttgcggcagtttgcaagaaagaatggtaagaagtatagcgctgcctttttcatatctgattattatgccaatgaagccatcaccgttttttattccaaagggctgaatgtgccggatgatatttccgtagttggttttgatgataacatatatgccaggctgtcaaggcctgcgcttaccacggttcgccagcttcctgaggaaaaggggaaacaggctgtggagttgcttatgaaaaggatccggggagaagaaagcccggtgcgttccctcacgcttcctaccgagttgattgtgagagaaagcaccaaagcggtatttccctccgaagggcggcggtagagggggaaaacagacgtatccgtgccagggttcctcccgtccttttgttccgcctggctgcgccttgccctttctcctgggccggggacggctttggatgttgtttcagttccagcctcaaaaacagggtgtttctaaatatttcattcttccggaattctgccagcgcggcaaaactcctcgctttcgctcgtcagacaagccgctaaggacggcagccttccggaagaatgaaatattaagaaacatcaccgttttttcccatggaactgaaacaacatccaaagccgtccccggcccgggagaaagggcaaggcgcagccaggcagaacaaaaggacgggagagaccatgggatggatacgtctgtttcggcaagataaacattttcagcagataatattttcgttggtactctattcattctcgatagttttcaatggttttcgacaaatctcaatccaatcataaacactaagtacgaatgccaggtgatggtggtctctatcctaactgctgaaaagttctcggcattggtagagttgtaattattgtgtcagcatattagtagtaaggaggtcagacagcgggaaaatatgcgtttttacttgacatactaactcaaattccttatactaaatactaagaaatgggttttcaccgtacagtttatgactcaagcgggctgctcgtttctttttttattgccagcagatcgtacaaatatttcttcccatcctcatcatgccttacaagcattctagctgaaaaaatattataccgaataacctgtccggttttatcatcatatacgggcaatgcaaaacgtacatcataccgataccatccgtactttgcagccttttcatgcttttttttaatatttttagaaaattctcgatttgtggcaatctgaatcaattccggaatcccctgagccgcatttgctttggctttcgccactgcaccttttaatgctatcctgctctccgaatttgcatattcatccgggaaatccgtagagataaatattttttctgatgtctcagcaatttcatagaattcttccacatattcttttaaatatgtttctacattctcccaatcttcccgcctcttcgctttaaaacgaatatcattaatcagaacgaacttttttccatcaaggtctgttataatgtttacgtttctatccaacaatctctccctcctcatcattactcttcaaagaaaacctctgcaatttttgcaatagtttccttccggcacagttaccacatatataacacagcccttttctgacattttctacgtttattctaccatgaaccatatgtaaaagatagaaaaagcgccaacggcttataccaacagacaccactgctttcatgcggactcattctcgatttttgttttccaattttttttttgctaaaaaatatatgcccgcaaacccgtatgtttgctggatttcttgtgctttcctcacaccctgcagaaacaacttgtgttcttaatcactggaataagtggcctttatttgtacattctatacaattagagactgtttttttgtgcaataaattggttttgaagaacacttattgaacaacctgacaaaaccaactaatcttttagatagaaagataccgaaaaaatggtgtttcccggaggacgggaaacggctgaaaaggaaaggggattatatatggaaaacaaacaggcgaaatggtggcagaaggcggttatttatcagatttatcccaggagcttttatgacagcaatgcggatggaataggagatcttcaggggattatacagaagctcccttatctgcaggagctgggaattgatgcgatttggctgtctccggtattccgttctcctcaggatgataatggttatgatatctccgattatcaggatattgatccgattttcggtaagctggaggatatggatgagttgatcgcggaagcgaagaaaaggggaatccgtattatcatggatctggttttgaaccacagttcggatgagcatccttggttcctggaggcgaaaaaaagcaaggataatccctatcatgatttttatgtatggcgtgacggcgtggagggaaagtatccgaatgatttgaaggcggccttctgcggtcctgcatgggaatgggtgccggaatgcggacagtattacctgcatcagttttctgtgaagcagccggatctgaactgggaaaatcctgcgctgcggaaagctatttacgatatgatcaactggtggattgaccgcggtgtgggcggcttccggctggatgtgatagatctgattggaaaggatacggataactgtgttatggcggaagggcctatgcttcatccttttatcagggagatgagcagcaataccttccaaagagccgatttggtgacggtcggcgaggcgtggagcgccactccggagagggcgttcctctacagcaacccggacggctccgagctttccatggtatttcagttcgaacacatggtgctggatcagcagccggggaaagaaaaatgggatttggccccttttccttttgtggaatttaagaaggtgtttacgaaatggcagcagagtctgtaccagaagggatggaacagtcttttcctggataaccacgacctgccccgggcggtatctcatttcggaaatgatgaaaaataccgtgtggaatccgctaaaatgctggcgactatggtacatggcatgcagggaaccccttatatttaccagggagaagaactgggtatgacaaatgtgagatttgacattgaggattaccgggatattgaactcctgaacatgtataaggaacggatggaaaacggatacgaggaacaggatatcatgcgttccatttatgccaagggcagggataatgcaaggactcccatgcagtgggatgaaagcgcaaatgccgggttcacggcaggaaccccctggatccgctgcaatcctaactatacagtgatcaacgcccaggaagagctggtggatcaggactccattttccattactataaaaaactgattgccttaagaaaaaaggaaaatatccttgttgacggctggtatgagccggtgatggaagaggatgaggatatttttgcctatacaagggaaaatgatacggaaaagctgctcgttctctgtaactttaaagaacagccccggacacggatccttccggaggtgtggaaaaacggggaagtgctgatttccaactatccggacagcaatgcggacggaaatttacggccctttgaagcgatgatgataaaggtgagaaaggggtaagaaaaatatgagaaaacgggggaaagcggcggcctgcctgatgattactgcattaacggcaatcgcagcggtgctgcccggctgtcagccgccggacaggaacggcagaatcgagatagagcttgttcagtataagccggaagcggtggaagtatttgaaatgctggaagaaaaatttaatgcctcccatgataatatccatctgactattgaatcacccaacgatgcgatgaccatcctgaaaacccgttttatcagggaggacgcgccggatattattggtataggaggagatatcaactattccaatttcctggattcagagatgctcatggatatttccgattaccggggccttgcggatataaacccttcctacctgactattgacaagcagcttgaatttatttccatgaacggtacctatgcagtcccttatgtggcaaatgccgcaggtgttttatataaccgcgccatgtttcaggagaacggatggaaaatcccggaaacctgggaagaatttaaggctttgtgtgatacgatacaagccgcgggaatccagcctttgtacttcggctttaaagacacctggaactgcctggcgccctggaacgccatagctgtggatttggctccggccgacgtatgcagcagggttaacaggggagaaaccacttttactgaacagtacagggaagtggcggaacgtatgctggagcttcttccttatggacagaaggaccctttttcctacggttataatgatgcctgtacagccttcgcacgcggacagtccgccatgtttaccatcggcagctatgcggtgccccagatcaaatccgtgaatccggacattgatattgatacctttgtcctgcccgccagcgataatgcacaggagaatgtgctcaattcaggtattgacctgcagttttccgtcatggcggactgccctgaaaaagaagcggcctatgaagtccttgatttccttcttgcggatgagaatgtacaggcctacctggataaccagaacgccgtgccctgtaagaacggggactttaagcttccttccatgctggacggcgtcgccgattatattaaggaaggaaaaatggtggattaccaggatcaccattatccgacggaaatggcggttgacgccctgatacagacctatttgattcaaaaagataccgatgcttttcttgccgggttcgatcaggactggcagcgttataacagggatctgattgccaaggtacagcggtatgaggaagaacatccggataccggtgcggaagggggaacgaatcaatgaataagaagaaaaaaatgagtgacagagacagaacctttctgctgattacgatacccatcctgctgttgtttttctgcttcaatacgctccctttgctgaaaggctttctttacagcttcaccaattttaaaggctacggaagctatgattttgttaagctgagaaactacatcgatcttttccgggatgcccgtgtgggaaaatcctacttgtttacctttaagtttgcgctggtttccacaatcctggtaaatgtcctgagcctgattcttgccctggggctgaacagcagaataaagggaaaaagcgcgctccggggaatttattttatacccaatgtactgggcggactggtggtaggctacattttcagctatctttttacctatatcctgcccgcgctgggataggcggcggggatcgaagcactgagtaccagccttttgtcaggaaccggtacagcctggtttgccattgtgctggtatgctcctggcagtcgatagccatgaataccatcatttatatatccgggctgcagaccgttcccgaggatgtgtatgaggccggagccatagacggcgtctcaggctggaaaaagttttggagcctgaccttcccgctgatcattccgttcttttccattaacatggtgctttgtatgaaaaatttcctcatggtcttcgatcagatcatggccttgactaagggcgggccggcacagagtacggaatccatttcctacctcatctataacaacggtatgagcggagggcagttcggcttccagagtgccaatgcctttgtgttttttatagttatagtagcgatatccgtcattcagatgcgaattaccggtaagaaggaggagcagctatgaaaaaaggacagcaaaaaggaacgcagcgggtcaattggccggttacgattcttttgattctgggaagccttacgattttcttccccttatatatggcaatcgtcatagcctttaaaagcccctccgaaatgaccaatgacatcgccggaattctgtccctgccctccgcattccgtctggataactttacagaagccatgcgggtaacagatttctggcattccctgggaaacagcctcctcattacctgtacggtcatccttatagccattgctgtccattccctggccggatacgccatcgggcggaatatggcccacagccgtttttataatattgcctacctgtacattgtgagcggtatgttcgtcccctttgctattctcatgatgccgctggtaaagcaaacagcccagataggactggcaaaccgggtgggggttatccttttgtatgtggtattctatatgcccatgaacctgcttctgtattccggctacctgaaaaacatcccgctcgcgctggaagaagcggcaagagtggatggcgccagcacctgggagacctactggaaaatcatttttcccattatgaagcccatgcacgccacggcagcagtcctcaccgcactgggaacctggaatgacgtaatgacgcctctggttatcatgtccggaaccgggcacaatacgctgccgcttgcacagctgaacttccagacacagttcgggacgaactataacctggcattcgcctcttacctgctggcgctgcttcctattctgatattctatctgttctgccagaaacagatattgaatggtgttgtaaatggagcggtgaaataagaaacaattaatttatttctggtcaaaaatcgaaggaaacagagcaacatcaaaaaagcagatgcttaactggcatctgcttttttggcgtgcgaaactttttatccatccggatgttttattttccgttttttatttcgcaaaatctcaccttatgcgaaaagacgcgtaagaagcagatatattctatatatttgtagtacttctgaccatttttttgacggctcagaaatgaaaaggaagatggaactgattctcccccagctaagccgtcatccgataatccgccatcagcatttttttccgctgcatatcggaatggacatagatacgcatcgtggtagtcacattggaatgtccaagcagttcacttactgttttcatatcaaatccatgggaaatgcagtttgtggcaaaaatatgccgcagcatgtgaaaattaaaggaagggatccccaggcttttcagaattctcaggaaccggtattgtaaggttctcggctcggtatattcttttttccttcccggcatcagataatcctcctgtctgcctttccatttttgcagaagcgtaagcagataaccggggagcgggatctctctgtctgaattacctgatttgggggaagtaattgttattttcgttccggttgaataacagcctgcttccccgctgttaatgcaaaaagtgcggattctctgcagtgtcctgccgatatgcatcgtacctttctcaaaactgatatcgccccatttcagggcacacagttctccaatacggattccgctgcagccggtcaggaggatgcccatgcaggtaacatcccctttcagcgcttctttctgcaggtatgcttccagcttccgtatctctgtttccagagggggatgtaccggcctgtgtctggcggcgtaaggcgcgtggggctgttccagcccggtacagtggtatttgtccttcaggaactgcagaatctgtcctaaaataatgtgtatctggtgcagatactgctcggaaagtttttttccctgtttcccttcccgcagaattttgaaatattctctgtatgcggcaaaatcccaggcttccgccggtacggaaccaatcagcggcagaatatgcttctctgtaatggaacgataggtggaaagtgtggattccttccaggcacctctgcgttcctccagccacatcccggcggcctcccctatcgtaaggccggtcggcagacagccatatccgcctttttccaggagctgttctcttttctttaaaaaaagcttttccttcacttccttgtaggttttcccatagacagaagcatatttttgacggccgtccgccatattgattttatggtaacgtccttcccagcggccatccttccttttatagatattttccccttttcttgccatagtctcctccatcgtcctgacgaattatttgacggctcataaattaactgcaccacctatggcaactcaaacgtagcttgtattccgtaaaagtaagtactctctgtttgtcagcaatgtcatttcccggtaatttatacctgatgcgacagaaaatgacatttcaatatatttttttacgcattaattgacaaaatacaaaacttgtcttacaataaattccagtgttgagtttataattaccataaaatgtcagtttaaaacttactctaattttcgcataaggtgagattttgcgaaaaacggcgataacagttttaaaccgacatgctcccattgatgccttataagccggttatcagacaggaaaaccgcggatgtgccgtttccctgtcatgggatggcttaattgtataacagatcagggagcttcggaaggtgggaaagaatggaaaaggaaacttatgacaggaaggcagccggcaatcggatacgggagaagcgcagacagctgggaatcaccatgaaagaagcggcagaaaagctgggaagagtaccgacctattatgcggatatcgaacggggcagctgcggaatgtcggtggaaaccatgattgccatatcccggctctaccatatgtctctggattacttaatcctcggagcagaagaagaggaaaagacagaagatgcaggaaggacataccaggaagaaacagaggctgtataccagcttctgaaccatgtgtcgaagaaagaaagactttacgcggccaaggtcctgcggacctttctgattgcctgcagtgatatggggacagaggacggcaggacagaacagaccatagccggtccctcaaagggagagtaagaaagaatgaatggactgattgatatccattctcatatactgcctctcgtggatgacggggcggaaagtgtggaaatggctctgcttatgctgaagaaagcagcagaggaaggaattgaaaaaatcatactcactcctcatcaaaaaccggatcgaagatgtgttacgccggaaggaatactccggagaatggaagaactccgggaactagccggaaaagaaaaaataccggtgcagctctatccagggaatgagattttttaccgccatgggcttgcagaattgctggataaaggcaaaatacggactatggcagattcccgctacgtactgatcgagtttttgcccggagaggattatacctatatccgggatgcgctcagcagagtcgcctcctttggataccgtcccataacagcccatgtggaacgatatgtgaatgtaatgagccggatagacaaggcagaggaactgaaagaggacacaggctgctattttcaggtgaatgccgccagcgtgacgggtgagaatggtttttccgtaaaaaatatgactagaaagcttgtgaaagaaggacttattgattttattgccacagatgcccatagaagcgaaggaaaacgaagccctgatatgaaagcctgtgcagaatgggtgaaaaaaaagctgggtgaggaacggatggaacagatattctgcggaaaccccacggccctgctgaaggataaaatcatatgatacagccctgacatttttaaaaataacagaaccgccaaaaattgatgagcaaacaggaatacagattggagaatacaaaagtgatggaagaaaacacaatgcagcagacagatgagatagaaattgatttatgggaaatctgcctggtgctggtacataatctggcattgattgtatctgtgggaattatgactgcgctgggtacctttctgataacacagctgtttatcacccccaaatatgagtccaccactaaaatttacattctgaataagcaggaaaacaatgcagttacctattctgatatccagctgggcacccagctgaccaaagactatgcggaactgatccagagccggtttgtcctggaagaagtagtacagggaatgggactggatttgagttatgaagagatgaagaaaaaagtatccgtaacaacaccgacagatacccgcatcctggctattactgtggaggataccgatccggtgatggcaatgcagctcgccaattccattcgtgaggctgccgccgtacatatcatgaatgttatggatatccaggccgtaaacgtgtcggaaaccgcgaatatgcccatgaaaaaagcgagccccagcgtgatgaaaaatacatttatcggcggtgtgcttggcatattcctgatgattgccgtgattttggtgcgtttccttatggatgataccataaagacacccgaagacgtggaaaaatatctgcagctttccaccctggcggtaatccccctgaacgaaggggaagaagacgggaagaagaaaaagaaaaaagtaaaaagaaactagtaagagaggcagaaaagagtatcgaaggaacggttgcttttctgctgttgtcttgtgcggaaagcagaaatggacagctgtgagcggcaggagtgtacggctgttacctaccaaaaacggatacaacggataaaggagaaaggccaccatgcagacagtcacatttaattccatagaaaagctggatttcagaacaaaggaaagctataagaccctgcggacgaacctggaattttcaggaaaagacaggaaagtgatttccataaccagcagtacgcccaatgagggaaaaacgagcgtatcctttcagcttgccctgtcaatagcggaaggcgggaaaaaggtcgtcctggtggatgcggatcttcgaaaatccgtgctgaaaggccgttataaaaccaatgcagcccggtatggcctgtcccattacctcagcggacaggcatccatttcagatatatcctgcaagaccaatattcctgacttttatgtgattttttccggcccggtgcctccgaatcccagtgaattattgggaaacgatgcattccggctgctgctcgaatatctgcggaaggaatacgactatgtgatcgtggatacgccgccgttagggagcgtcattgacggtgcggtagctgcgcagcactgcgacggaaccgtcatcgtggttgaaagcggggctatcagctataaatttgcccagaaggtaaaggaacagctggaaaaagtggactgccggattttaggcgtgattctgaataaggtgaatatgagcggcaagggatattacggcgcttattatgggaagtattacgggaaatattacggaaagtattatgggaatagtgaggaaggcggactgcatgccgcggtggtgcagaaggggacaaaaggagccaaggcggtgaagggggaaggaaatctgcattcccatgacaataaaagtaccagagaatcggggaaagaaaaggcagcggaagaagacgtaatcgctgaggatgatatgattcagcttgatatggatatggtggaattggtggaagatacggaattgatagaggaactgaagtaaaggaggcataagaggagtatgaaaaagttagtattcataatcggaggaattgacattgttctcctggcagtttgtatgtttctttatctggggaaggacagaaccgcgccggtgatctcatttggcgagaatgcggtgagctatgaagaagggatggatgaaagccttctgcttcagggagttgtggctatggatgagaaggacggagacgtgagtgacagcctgctggtggaaaagatagcggggacaaacgggaaagaagtgattgttacctatgtggcgagggacagtgcgaataatgtggggaaggcctccagggcgtttcctgtggcagggagttatacgggaggagatgtgctgtctgctgcgggggaaggactggacgacgaatatggaatggatgagagcaggatggaggagtcggagacagagacggagagtaatgaggagagtagttctgtgccggatgatgtggacaggaatgatgcagaggaggaacggaatgggggagatggagaagaggggaggcaggatgaacagggtgaggaacctcaggaacgtcaggaaccgcaggctgggtcgaatccggtgttggtgacgagcggggatgtggtgagtacgaaaattggtacagcgccgaattggggacaggtgatagcggcgatgacggatgataaggatgattataatacgctttataataatttgaagctggaggggcatgtggatttgaatgcggttggggagtatccggtgacgttgtatacggtggattcggatgggaaccggtcggaggttagggatttggtggttagggtggaggagtgaggatatagtattactgcgactttctattcatataatagtgatttgtgcagaaaagtatagatataaaaatacagtaaaaaggagtttccttaatgattattacaagagcacctttccgtgtcagtttttgtggtggcggaagtgaccttccgtgtttttatgaaaaatatggtggttgtgttttaagtacgactattcgtaaatatatgtatcttactattcataattacttttataaggatcagattgtcttaaaatactcaaaaacagaaattgtaaaagattattcggaaattgaacataagatatttaagcaatgtcttagtgattttgaaattaagggtgtagaaatctctagtatggctgatatacctgctggcactggattgggatcatcaagtacttttacagtagcgttacttcatcttctttatacgtataaaggggattatgtttctaaatataaattagcaaaagatgcttgtgaagttgaaatagaaaaattgggtgagccaataggaaaacaagatcaattcgcagcagcttttggtggcttaaaatactatgaatttcttcctggcggttttgtaaatgtgtcacccattattatgacatcagatagttattctaaactagaagaaaatttaatgatgttttatttgggtgggacccattctgcttctaaaattttaaaagaacagtcaaagaatatcacacagattaaaaaagcaacagtacagcaaaaaatgtgtaatcttacaagaattcttaaagacgaacttcaaaaaaacaatgtagatgccatgggagaacttttacatgaaaactggttattaaagaaatctttagcttcaggaatatcaactccaataatcgatgatatatatgatagagctataaaagctggtgctagtggtggaaagctgttaggagctggaggagcaggttttttacttttttatgttcctcaggataaacatacttctgtacgtgaggcattatctaattttagagaaatgaattttgaaatggataattccggtgcatcaattgttcaggtggatagagatttcgtataaaaaggaggttattatgaaagttttagttactggtggtgccggttttattggcagtcatcttgttgatagattattggaagaaaataatgatgtcattgtagctgataagttgatctttggagataagaatattaagcatttagtaggtaataagagacttcttaaatctggacgatttaaatattatcaagttgagtgtgcaaaccagaataatgtggacagattgttcaaagaaaataaaatcgatgcagtgtatcatatggcggccaattctgatattcagaaaggaggaagagatccgaagattgattttaatgatacatttttgacaacacatgcacttcttgaaggaatgagaaacgcaaatgttaaaaatcttttttttgcgtctacttctgcagtatatggtgaaatgcttgatgttgaattgacagagacgactggtgggattaaaccagtttcctattatggcggtacaaaactggcctcggaagctttaatttcttcttatgtttctatgtgcgatatgaatgtagtgatctttcggttccctaatgttattggacctcgtttgacacatggggttatctttgattttattaagaagttgcagaaatatcccaatgagcttgaaattttaggggacggaatgcagtgtaaaccatatatttatgtgcttgatttagtggacgctattacaaagcttacgaaagaatggcatccgggagaagaggtttataacattagtgtaaagggtaaaggaagtacagtcactcacatagctgaaattattgttgaagtgctcggattacaggatgttttattcaaatatactggtaatgatagaggatggaagggagatgtgccacgattcaaatataatatatcaaaaattctggctactggatgggagccgaaatatacatcggatgaagcggtaaaacagacagtaatagatgttttgaaagaagtgaaatacaaatctatttgaatatcattataaaggatggaaaaatatgcaggcggttattatggcagggggaaaaggaacaaggattcaaaccattgcttcagatatacccaaaccgatgatttcgattttaaacaaaccaatacttgaatttcagattgaaaatttaaagaagagtggaataacagaaataacgcttgtcataggatatcttggttatgtgataaaaaactattttggagatggaagtaagtggaatgttactatcacttatgtacaggaagatgagcctttaggaactgcaggagcgctattttatcttaagggaaaaataactgatgattttatattagtatttggtgatttgctcgttgatttggactggaatcgttttatgaaattccataaagctaaaggagcaattattaccttattgggacatcctaatacacatccttatgatagtgatgtaatcgtcgtagatgaagatgcgaaggttctatgtatcgattataaaaataaaaatagggatacttattatcataattttgtaaatgcaggtgtatattgcatcaacaaaaagttgctagatacgattaaatttcctgaaaaacttgatttggagaaaaatgtgatttcagagttgatacctctaggaaatgtctatgcagacagaaccactgaatatgtaaaagatatgggaacaccggatagaatggcgtcagtggttcaagatataaagaatggaattgttacaagacgtaatcttagaaataagcagaaatgtatctttttagacagggatggaactttgaatgttcataaaggttttcttaaatctgcagagcagtttgagctacttccaaatgttcatgatgcaattaaaaagataaattcttctggttatcttgtaattgtggtcacaaatcaaccagttattgctagaggtgaatgtagttttgaggaactttctagaatacatatgaagatggaaacagaactcggtaagcatgggacatatattgatgatattttcttctgtccacattatccccaaaaagggtatgaaggagaaattccagaactaaaggtagactgcgactgtcgaaaacctaagatagggatgttaacaaaggcagcagataaatacaatatcgatttgtccgcatcatggtttgtaggtgatactaccatggacattcagactggtataaatgcgggcatgcacactgttcttattcatacaggtgaagcaggccaggatggaaaatatagtgtatcacctgaatttgaaagtacagatttacttgaagccatccgtcggatattatcaactaattgatgcaaggtaaagatgagaggagaaaaatgaattatatagctaaactacaggcatatttggatttggagattgaagctatacgttcaataaatctagcttcagttgaggaagttatgaatgtgctagaaaaagctcgaataaatggacagaaaatctttatatgtggaaatggcggtagtgcggctacagctagccattattgttgtgattttaataaaggaattagtgagaagggggaaaagagatataattttgaatgtttgagtgataatgtacctacaatgatggctgtggcaaatgatattggttacgacgaggtgtttcgttttcccttgaagaataaaatgaatccaggtgatatttttattggtgtttcaggttcaggtaactcaaaaaatgttgttaatgctatgaaatatgctaaaagtattggcggaacgacaattggaattgttggtttctctggtggagtaatgaaggaaatagctgattataacattcatataaatgttaataatatgcaaatctcagaggacgttcatatgattattgatcacttaatgatgtatgttttggaccattaaatcggttaaattatatacgaggagaaattattgtggttgctaaaaaaatagatacaaatagaattagctttttaaatacgtatattgataaccttacagcatctgaggcaataaatgttgttgaccagtatatcagagagagaggtgttcattatatagtaacaccaaatacagatatcgttataaagatgcaggaggataaagaattgaaaaatatctgtaaccatgcggatcttattttagctgatggtcagattattgttaaattgtctaaatggcttggacatccaataaaggaaagagtatgtatgacagattttatttgggatgtatgtaatctggcaaatgaaaagggatataggatatttctattcggggggaaggataatgtccttgaaaaagctacacaaaatattaaacatcgttacccttatcttgatgttgtggactcgtattcccctccatttggatttgagaaagataagcaactgttggaggaagcaaatcgaagaatagcgaatcgtggagcggatattttgattgtgtttcttggttgtcccaaacaagaaaaatttatttaccagaacaaagataaatataatgtaccagtatcttttacaatgggtggctgtgtcgattttttgggtggtagtgttaaaagagcaccaaaatggatgcaaaatgcaggattggaatggttttttcgttttttacaagaaccgaaaagaatgtttagaagatattttatagatgatattaagatctttgggttagcatggcaatatagacggagaagaaaaaatgaaaaaatataaagtactcatgtgtggatctgatttttctgttggtggtggtatgattgctgttgctaaaaattatttggattataaaggtttgaaaaatatagaattcatttatgttccaactcatattgaaggtaatgtaataaaaagaagtcttatatttataaaaggatacttaaccgttttagatctattaataaaaaaaaggatagatctggcgcacttacatacaacagagaatggaagtttttttagaaaaggtattatccttcgaacattaaagaaatttaaaataccaactataatgcatcatcatatagactatcaattgttttacgaaagctgcaatgatataaagcagaaattcattagagatacgttttctatcgcagatatgaatattatgctaggggaatgttattgcaattgggtaatagaaaaatcaccgaatgcaagagtatgcaaaatttataatgccgttaattcttacgatatcaataaatataatccagatggaaacttaattatgtttttggggtggcttatagatcgaaaaggtatatatgaatttttacaggctataaaaaacttagatgataaattagataacaaatataaggtggttttatgtggcgacggaaaagataagatcgagccagtaattgaacagttaagaataaaacatcgaattgttcatattggttgggcagatcttaaaacaaaggaaagatttttttctgaaactgtgattaatgttttaccaagttggcgtgaaggtttacctatgacaattttagaaacaatggcttatggaatacccaatgttgttactaatatatcaataatgtctgaagttattagtaatgataaaattggaacagttgtgcaaacaaaaaatgttgaacaattaacggaggcaatatataggattataaatgatagaaatttgcgcttagttcaaagtgaaaattcttataacctaatcaaaaataagtttgatattctaaatcatataaaacagattgaagagatatatttagatctcttgaaataattgtatctggcaatttaataattaagaatatttaagagaagcaaaatttgtatgaaaagaagaggactaaatgttagatagactgagttaaataattagaactcaatatttaaagagacttaataattaatggacttgtaattgggaatgacgtttaaatgaaaaaaggttgtattattgatacaaatttaccatggctcatttgtataggtgattatggtcctttcatcggagatatacatttatagggattaatagtgtagttatatcaaatacaatttatgggggttcctgtagaaaaattataaatattatcgagtattaataaaagtacaagaataaaataaattatgtatctatctactaaaacattttgacaatgggaaataaataatgataaaaggtaaaataataaatgagatttggggaaattaggagaacttatagttgcagaaatgaaaagaaggaaatccaatgaaactaagagtagaaccatatcaatggattataaaatgcataacattgtattctctatctacaattatttatggtattgtgaatgattatttacctcttaacacaatattagggattatattgataattttgtttggaattttgtatttaaaaaatttaaaaaaaagagatatctatttttttatttgtgttttatttttattcgttttcgataatttagttgcaatagataaagcagcaagtataagtgattcagtgtactgggtatttactcttttagcgatttggaaagtatgtgatgaagaaacttataaatgtttatatatggcaatagttaaacaaagtgattttataaagattatatttactattaacaattttatattagtcggaggcctttttttagggaactgttacagtaaaagttggggttctacatattatgttggatttgcatattctaatcatgtattggcaagtggtgcttgtataacacttgttatggcattatatatatttaatgatattaaaagtattttccttagagtattgattctactacctgctactattgcaatcctgcaaagtggagcaagaacatatattgttagtattgctgtaatatggttgatttattttttatattgttttcagaaagtaaatataaagcttttttttattccatttgcaactattgtcatatcatatatttttattaattcaggaatgatggtgaaatttattaatccaaatacttatgtacaacaaacaggtattgaaacattttctagtggaagaacagtgttttggttgatagacctacaggcttattggaatttaggatttattaataaattattcggcaatgggtttgactttccttactttgtaaacagaactttatataaatcttctatgaatgtatgggcacataatgattttattaatacactgatgacttctggtgtacttgggataggtctatatttaacaataatcagaaaaatttggaaaagcttaaggaattacactccttttatattatcaagtttggtttggatatatgtagtatttgttatgtttattaatggtttctttgtttatcaacattatttatttagttttatcctgctttttatatggtctgtaaataatacaaaaaataaatcattgtgtaatctataaataatttttaataaatgataggcggagttaagtcatggaaaaaattcttacaattagtatagcagcttataatgctgaaaaatatttagtcagatgtttgtcttcttttatatcatcagatattttatcaatgttagaaatattggtaattgatgatggttcacaagatacaactgcacaaataactaaaaaaatagaaaaacaatatcctgaaagtatacgattaattcacaaaaagaatggtgggcatggttctacaattaatacaggtattaaaaatgctactggtaaatattttaaaacagttgatgcagatgattgggttgatcaaacaggcattagatatcttttaaattttttaagcaaaaatgacgttgatttaattttaaatccatataataaagttaatgaatatggaaatattatagaggatgtaccatgcgtaaaatcctcaatggttgaatatggaaggatatatcaaatagaggatattgcacaaatacttattattgcgatgcatgcttttacgtttaaaactcagatattaaagaatatgaatagagaaatagatgaacattgcttttatgtagatgctgagtatacgatttttcctttaccattagtacatacagtgacagtgctggattttcctgtatatttgtatttgtcaggaataaatgaacaaagtatgaatattcaaaatatgataaaacgtagagaagaacatttgcgtgttatcagaagagttattgaattctataacgaaaagattggaaatataagagatgaattaggacaattgatatacgaacgtataattgaaattatcaaaatgcaatatattatatatttttctatgaatgatttaactcaaagtaaaaaagaaatacttaaatttgagtgtgagatacatgaagctaataatgttctttacattggagtattgtcccaaaaaaactactatagtatgaaattattaaaaatattgagaattataaagttcaatggatataaagaaataattcgaatactacaattgttaaaactgctttgatataggagaaaatgatggatattatgttaaaattgccagagcactttttggaagaagaagataggagtggctatcatatatcaactttattaaaaaaggtatgggctgtagaactcgatttactttatattttggacaatgtttgtaaaaaatataatattacatattgggtagatggtggaacaattttaggtgcggtgagacatggtggttttattccctgggatgatgatatagatataattatgtaccgacgggattataataaactttgctcaataataatagatgagttaaaagaaccatatttttttcaaaccgaatatactgatccaggctcttgccgtggtcatgctcaattacgaaatagtaatacaacaggaatattaaaatcagaacttccatttaaatattcttttaatcaaggaatttttattgatatattccctttggactatattcctgatggaaacacagaagaaaaaaaatatattaaaaatatcgaaagattaacaggtaaagcacaaagatattctttatatacatattcttatatgccctctaaaagaaatattttaaagaaggttctaaataaaacattattaagaactttacattacatacatgggacggatcttttacctaatccgtattttgtggagtttgaaaagttggttaaaagtagtgatatgtcaccgactaaaaaactcggaaaactttttagaaatcctgtgcaagaacgatcgatttggaatactgaatggtttgattcaacaatttatattcaatttgaaatgcttactgttcctattccgtcaggttatgaaaaaattttgaataaattttttggagaatggaggacaccgaagaaaatgaattcaacacatggtaatgtattatttgatgtagataagtcttatacatattatagtgggggggggtacagcttaaataagaattcctccaatgctccaattttattgttttttatagattctaaactacattcatgttatgcgaaggaggcggcataacatgaatgagattcaaggtagagaatatgaagttttgactgaacttaaaaagatttttgaaagacatggattaaggtattttgcagtgggaggtacttgcattggtgctataagacataagggttttataccttgggatgatgatattgatattggtatgccaagaaaagactttgaattgtttcgtactcaatattataaagaattgccatgtgaatataggaaagttgatggtgataatagtttaagccataattttttattttttaaagtacatgattcaagaacaacgtatgtcgagtattatgcagaacatactcctgacagatatactggggtatttgtagatattatgccagttgatggtttaccagttcaagaaaagcaaattaaaaatcttataaaaaaaataaatttgctttttttacttaatagttggaaacgtccttcatcacgaaagggaacatataaggaaaaaatgaaggattttatagaaaatatactgttgaaggcttttacatttaattatttctcaaataaaatatataagttaatgaatcattatgactttgatacaacatcaaaagtgtattttacatggagagatcctgctatatcgattactagaaaactgtattcaaaagaatggtttgcatctacgatagaggtaccttttgaaacagggacaatagcagttcctgttgggtatcatgaatatttaacacaggactttggaaattatatgaaattacctcctaaggaagtacagaagtctgttcataatatttatataagtgatatggacaggccatacagttattatgttgagttggaaaagaaaaggtataagtagataagttttttcaacttagtttataaattatatgtaattaatctgacaatttatagtgaggagaaaaaaatggttataggctatactgccggcgtttacgatttgtttcatgttggacacttgaatttacttaagaatgcaaagggaatgtgtgataagttagttgtagggattacgacagatgaacttgttacatataaaggtaaacattctatgataccttatgaagatcgaatggagattgttaggagtatcaaatatgtagatgctgttgtcccacaaagtaatatggataaattgactatgtgtaaaaaattaggtgcgagtattttgtttgtgggagatgattggtatggaacagagaaatggaagaattatgagaaagaattctctgagtctggagttcagatcatttactttccttatacaaaaggcgtatcttcaacactgattacacagacgttattacaggttagagataatccagaaaccagtataaaaaaaagtccttaaattagtaggaatggaaatagagcaaaaatatgtacttagttttaataaggagaaattttgaatgagattgagtaaatatgaaatgagttcatttttaatgtaccgcatggttaatccgtgtaataataacataattaaagaaaaattcccgaaaagaataccaattcaaacgtccaaggaattagaggatcatctaaaaagtaggatgctaaattatagtgcggggggggtatagcacttgcactgagtggaggaattgactctgctattttggccaaatttatgccgaaagattctattgcatatacatttaaatgtattgtaccaggaataaagacaacagatgaaactgtgttggcggcgaaatatgcaaaggaatgtggcttaaatcataaaatagttgaaatatattgggacgattttgaaaaatattctccattattaatgatacataagaaagctcctattcattcaatcgaagtgcagatttataaagcttttcttcaagcgaaagctgatggaattaaaacattaatatttggcgaagcagcagatgctgtttttggaggattaagtagtcttttatcaaaagactggctaatcggtgagtttatcgaacgttactcgtttgtactcccattttacgcattaaaagaacctatgttgaacttagaaccgttcaaacaattggaaactaatggaattattgacccacataattttataacaaatgtatttattaacgaaagtgttggttcctatatacatgcctgtagtgtattaggcatgaatataggcttaccatatgcagagagtttcttcgcttgtgacattaattatgagaaaatacgcagaggagaaaacaagtatcttgtaagagaggtgtttgaacgactatatccagattttgtaatacctgaaaagactccaatgcctcgtccgatgaatgaatggttaaaggattggagtggccctgtaagaaaggagttttggcctcattgtgcccagaatatgacaggggatcagaaatggcttctttggagtctggagaaatatatggatttgtaactgagtgaggtaaatgtgttgtatgtcttttaacattttaataacggcgtcttgatctgattaatccacttgtaaataattggattatataagtaataccagtgaaaataatttatttaacgaaggaaggtgtcattgattaacagggtttttaataagtataagaatctgccagttcagatgaaagcgtcattctggtttctgatatgtgcctttcttcagaagggtatatcaatgttgaccacaccaatattcacaaggttgttaactacagtagagtatggtcagtttaatgtttttacttcctggttaggtatcataacaatatttgtatccttgaatttgtcttatggagtttatactcaaggacttattaaatttaatgaggaaagaaatgcatttacgtcttcattacaaagcctaactacagtcttggtagttttctggatagtaatttatttagtatttcacgatatttggaatgaaattttttctttatcaactgttcaaatgttggctttactcataatgatatggacatcatctatatttggtttttgggctggcaaacaaagagttctttatagatatagaacattagtgattgtgacactaggggtctctattgcgaagccagttataggtataatatttataaaaattgctgatgataaggttactgcaagaattttagggctggttttagtagaactggttggttatactgctatgtattttgccgagatgataaagggaaaaaagttctattctgcgaaattttggaaacatgctttgatgtttaacttacccttaattccacactatctgtcgcagactatacttaacagtgcagatcgtataatgattagcagtcttgttggtgcaagtgaggctggcatatatagtttagcatactcaatatcatcaatcatgactttatttaatactgcattatctcaaacaataagtccatggatttaccaaaaaattaaggataaaaaggagaaggatgtagctccagttgcatatactactatgttattaattgcggaagttaacttattattaattgctttagctccagaagcagtagctatatttgcaccgtcttcttattataatgcaatatgggttatacctcctgttgcaatgagtgcttattttatgtactgttatgatctttttgctaagtttgccttttattatgagaagactggatttatcatgatagctagtgtgcttggagccgtattaaatataatacttaattactttttaataaatttttatggctataaagcagctggttatacaactttattctgttatattgtttattgcattggacattatatttttatgaataaagtttgtgatagattttgtaaagggataagaccatatgaattaaaaaaaatattattaataacaattccttttttactgataggttttctgctgttgttgacatatgaacatataattattagatatataatcattattactgctttgatttctgtaattgtaaaaagagaacaattaattgcggttctattgagattggtaactcttagaaaataatagttatatgtaagaaagttcctactaatatgtgaactataattatttatttcttttagtatcttgcctatatgttaatttttaagataagacttttaatttcttaaaaaatgcatttgtcacaagcatacaagaagtgtagtaactggtgatttttgtcagtagtgcattaattatttgtttatacttctagtaaaagtacttttatattcaaaaataatatttgttcgtttctctctatagttaattctagttgtaaagatattatttatgttctttgatttgttactaaatttagaggaaatattttaaaatgggcataagaatgttatctcatatttagttttaaataaaatagtataagcatattgtccatgttataataaaatcatataattcctcatacaaatgtcacaaaatcacaacaaatatcaaaataacgcaattgtcccaccccctccctttccctataataaaaatatcaaaaaaaggaggggtttttctatgaaaaagaaacaactactaagcattcttctaaccgccgtcatggcgctgtctctgacagcctgcggcaattccggcaataccccgcaggaatccgcagcatccaattccacttccacaacaccatccaccgaaagctcccagcccgcaggaaccgaagccgccgatacatcatcgcaggccgatcccttcggcaagtatgccgatccgctggaaatccattttgtccgcgccaccgatgacaccatcgaaaccaacgtgctcgccaaccttccgggccagaccctggaagataacttctggctggatacctacgaggaagagctgggaatcaaagttgtatacgactggattgttaaaggcgatgatgaattcaatcagaagatgaacgtatccatggcaagtgaagatcttcccgatgttatgtgcgtcacctccacacagatgatgcagcttatcgatgccggactggtacaggaaatggggcctgtttttgaacagtatgcaaccgatttcaccaaagaagttatgtatcaggaaggcgattctcccttcctggcaggacagaaggacggcgtgcagtatggccttccggttaccggcggcagcgttgattccgtagatcttatgtggattcgtaccgactggctggaaaaactgaatctggaagtccccacgactatggatgaagtgatgaacatgatagatcagtttgtaaacgctgactttgacggtaacggccagaaagatactgtaggtatcggcattgcaggaacctcccttctgggaggtggtttcggcggtctgagaggatttttcaatgcttatggcgcatatcccggcatttgggtggaaaaagatggacagcttgcttacggcgcaattcagcctgaatgcaagacagcgctggcagctcttcatgatatgtatgaaaagggctacattgatgctgagttcggcgtaaaagattccaccaaagcaggtgaatcggcagcggcaggaaaatgcggcttttccttcggacagcagtggctttccctcactcctttccagtcctgtaaagacaatgattccgacagccagtggtctgcatatccgcttcccagtgcaaccggcgagccctccacagcacaggcggatttgggaaccaacagatggattgctgtaaataagaatttcgagaatccggaagctgttgttaagatgattaatctgtttatcgaaaaatgctggggagaaaccggagataacggaaaatactatgctcctccggaagcggaaggcgtatggaagctttctcctatccagtgctccatgcccgaaaagaatctgcaggcttatctggatattgaagccgcccgtcagtccggggatgcgtcttcccttaccggagaggccaaatctattcaggataagctggacagctattattcaggaagtgacgaaggctttgctttatggggatgggagagaatctacggacctgcgcccagttcctattcttccattaatgagatgaatgaaagtggccgtatcatgattaataagtttgtaggcgcgccgacggaaacaatgacagagaagctttccacgctggaaaccatgcgtgatgaaatctacactaagattattatcggcgaatcctccattgatgattttgatacctttgtggcagatttcaataaattaggcggagatgatatgacagcagaagtaaatgagtggtattcttctgtgaaataagcagcttcgtaagaataacgggtaccagaccatgcggcccatcggttttatgccgggccgcatgggatttcttaccaaaagggttaaaggagtgggagaatatggcggcttttaagataaatcacaaaaaaaaacatgtgctcaagagggaacttcctctgcacatgatgctcataccgggaattattttcacttttatattttgttatatccctatggcaggtatggtaattgcatttcagaaattcattccggccaaggggctgttcggggatcagaaatggattggcctcgataactttacatatctcatcaacatgccgggagcgatgtcagccttaagaaataccgttgtcattgctttttttaaaatcgtattgggacttgtggttcccattacggtggcgatattgcttaatgaagtgcgctccagcaaattccggaggacagtacagactgccatttaccttccttatttcctttcctgggtggttcttggcggcgttatgatagatattctttccccttcccagggtattgtgaaccaggttctgaatctgttcggtattgattctatctttttcctgggaagcaataaatggtttcagcccacaattatcatgactgatgtatggaagggctttggctttggcacggtagtatatctggcagccatcacggggattgatctcagtctttatgaagcggcaaccatggacggagcgaaccggtttcagaaaatgtggcatgtaacgctgccgggtatccgtatgattgtggtattgatgtgtgtcctggctctgggaaatgtgctgaatgcaggattcgatcaggtgctgaatctgtacagtcctcaggtttatgaaacaggcgatattattgatacctttatttaccgcatagggctgattgatgcccagtttggcccggcgactgcgatgggtgtgtttaagtcggcagtttcctgtctgttcatatcggtttcttattacgttgcctataagttttttgattaccggatattctgacagtggaaacgggaggtagaccaagatgatacaaaataagaagaaaaaaggggcggtcacggtcagggaatccgttggctcccggatttttaccatagtaaataccctgatactggtttttctggcattgatctgtattctgccgttaatcaatatcctggcggtttccttaagctccaatgccgcggctacggcgggtcttgtgaagctggtgccggtggaattcacactgaaatcctatgaatatgtggcaaagagggcggcgttctggaaatcgctgggggtgacagtcatccgttgtcttctgggtgtttccctgaatgtgctgatgtgtgttcttacggcctatccgctgtcaaaggataacagtaagctgcggatgcggaccggatatacctggttcttttttgtcaccatgctgatcaatgcggggctgattccctggtatatgacaattaaaagtgtacatctgctgggaaccatatgggcgctggtccttcccggagcggttccggtattcagcgtggtgctgatgctgaattttttccgggcaattccggaggaactggaggaagcggcatttatggacggcgcgaatcattggaatatcctggcgaggatttatattcctctttccaaggccagtatagctacgatttgtctgttcgccctggtttatcattggaattcctggtttgacgggattatcctgatgaataagccaacccagtatcctctgcagagctatctgcagacaataatcatacagggggacacctctgtaaacagtaccacagactggcagaccatggcactggtttcagacagaacggtgaaatgcgcgcagattttcctgtccaccctgcctattgtggcggcctatccttttttacagaggtattttgtaaaaggtatggtaatgggatccgtaaagggatagaataataaaaaatgcatggggaggccgtggagatgttcaaatcgaaaacatttagaaagatgttgatttccattaccctggtatgtttttgtttttatggaatcggtctcttcagcaacctatacagccgcagggtgctggcaaatcagatacaggatactttggattccaaggtccgtttttgggaagaacagctggagcaggaagtgacaagccttctgctcacccaaagcagcctgacagatgacagcaaccttctgaagcttcatgtgatgtgggacagcatgagcagctatcagagaaatgaagccattaagcagttttcctaccggcttctcaatatcaaggtgcttcatggaatcgcggcctcgataaacacgtatttcccggaacggagaatggtagtcagtgcggatgcccccattctggatgagtatgaagaggatatatttgaaggatatgagcagttttatcttacggaagagggagatatctgtctgactgtttattttcccttttatggaagtccgcgggaagataaattgccccactattatatccgtaccaccatcaccccctatacgctgcaggatacgctgtcggaaatgctgggtgaagacgaggggattctttttcttatggacgcggaagaaggaagggtattggcgggatccgggaaaaagctcatggaagatgtggcggaaacaccggttttaaatgcggtcagaaagcagctgacagaggcggaagacgaggaaatgatccatgtatcggaggatggtttcgcttccggatgcctgtttcccaagctgggtgtctggctggtttactgctatccggacaggattctcgaagagccgctggattttttcgggatatttaatattgcactgactgtgcttgcgcttgctctgcttgtaagctatgcctggtatgcgagaaaatcctttgcaaagccgctggataaaattatgcaggctatggaggattttcaggataaggaaagctttttaatagaagagcaggatcgggatgacagggatgagctgactgtgatataccaccggtataataaaatcgtaaaaaagacggaaagccttatccgggaaaatctggattctaagtacagggtacatatcgcggaactgaggcagttacagtaccagatacagccgcattttctgtataacagcattttcctgatttaccggatggcgcggatggatgaaaacgaaacgatggccgagtatgccgaacatctggggaaatattatcagtatattacccgggtgggaaattccatggtaaaggtgagacaggagatcagccatatagagaattatctggccatacaggaaacccggttcggagagcggatccgggcatttctgggggatacgccggaggaggtaaaggatatggatattatgccgctgattttacagcctctggtggaaaatgcatatgagcatgggatgaaggattgtatgcggaatgggcaaatatggatttccatgtgttatgaatccggaattttcagttttacagtggaagataacgggccgggaatgtcggaggaagaactgataggggtatgtcggaaaatggaagagggaacgattgaaacggaagaaatccatgccatttccaacacgaatatccggttgaagcttcattatggggaggggagcggcctgacctttgaaaacagggaggaaggcggattccgggttaccgcccgtatacttttgggagaaggacagaatcatggatagtataaaatgcagccgggcggagacagggccggagggtgacagggaacgtacgggaaggccctggtataatcttctgattgtggatgacgaacctctgatcctggaaagtctttatcatatgctggtaaagcggtatggcaggaaatttcttatttatcaggcggcttctgcggatgaagcattagagcagtttaaaagcatccgcgtggatctcctgatgacggatatccgtatgcccggtatggacgggctttctcttgtcaggatcgtggaaaaagaatggccggactgtcttacggtatttcttacagggcacagtgaatttgaatatgcaagacaggccgtgagcagcaggacgataggatatgtgctgaagctggatggggacagggccattgaagaaataattgataaggcctatgacaggctggaacgggaatatgaggaaaaaagcaggtatctgaaaatgagcgcttcctggcaggaagcggcgccgcttctgcggcaggatatcctgaagcagatgattactacggaaaaatggacggaaaagaggaagaactccctgtcccagaaaatccaggcatccggcatggagctttctatggatgagaattttctgatagcagcgatatccatgccgccgatagaaaatgttcagaaaatggagtgtgaaccggcggcattgccgccgatggaaaatgttcagaaaatggagtgtgaaccggcggcattgccgccgatggaaaacgttcagaaaatggaatgtggaccggcagcattgccgccgatggaaaaccctcagcagctgtccgaagaggaaatatcctgcggcaatgtctggaatgcagtcacgatgagccggattcagtctgttattatggagagcctgaaatatgcttttcatgcgtattctgcatcagtctccacccatctttttctgctgcttgcccagtcggaggacaacagaccccagaggctgaagggatttttggagatcgcgctgtccatgtgtgaacgtatggggctgaaagcgccgcagatatatctttatgaagaacagacggatttggaagggctgacggatgctttttccgtattggggagaaaacggtttgaactgaccggagaaggggaaattatcctctgcggaagggatgcggctctgtctgactatacatggcgggaggaaggccctgtcatgggccgttttaatgtggagaagctgtcggaaagcttaagctatggaaatgcctcggacttcaggaacattatggaagagattaagcaaaatacgccggaagaaaatcctgcagcacagatagcagtgtataccacctttgcctccctgctgcttcaggcgatattgaattatctgcctgaggaaagcatgctgctcactcaccgtaatctgggacagatagcgaattacagcgcgcacagaggcttcctggatgcctgccgctgtctggaaggactggcggatgagtacttccgatgcagggaggcggttcatgaaaattccgatcattatatagtacataaggtgaatgcgtatattatggagcatctgtcggaggatttgtccatgactgtgataggggaggtagtggggctgcacccttcctatctgtccaggctgtataaaaaagtgacaaatctgtcgctgggacagtatatcacagccagaaggctggatttggccagggagcttctggcggatccctgcctgagaacacagagcattgcggaacagacagggctgaatacagcgtcatatttcactcatttctttaaaaagaatacgggaatgacgcctcaggaatacagaaaccagctgatggaaggattatcttaccagggcggcgaccaggaatgctgccggtaaaagacaaaaagggaggatgaaggatcatgtgtattatgtgggaaagcaaagggaataagaccttattccggctgaatggagaagaggcgctgttaattgtgactccggaaggaatgacggataccttcgaagaaaaagaagagggcgtatttttatggcacaggacgacggaggagccggtggtttccatgtgtatggaggctgaaacgctgttcgtgccggaacacactatggtcccggcagtttcttatgacgggaacccatggggaaaggatcacgagtacaagggactggaaaaagatggagcggcctattcctatgcctttcatcgctgtgcggtacccggagcgacctgttcctggaatgaagaactgggagctgcgctgttcggcacaggctcctgttccggaagtatgcagaaatcagcagaaggccatatgcatcaccgtatcctgtggccggaggtagaagggccgcaagtgctttattccgattgctggggaccggctttcaggggaacaatggagccttcttcttcttttaccgcgtggatatgcataggtgagggaaaaggtgcggtaaagaaaatgcttcatacagcatggaaacaggagtatgcagcgaaacagcctgtgcggaaaacagaggaggtctggaagctcagttcggattatgctcgtttattatatacggaagaagaggacgggcttcgcgctttcagcattgggtttacctggaatggaagggaatgggtgaaacggcctgactttaaatatgaaattgggtggtgcggacagaatgcttctttagcgctctcgcttttatacgattatcagatgaacggcagggaggaatcccttcgatatgggactgcagtcctggacagctgggtggaaaaagcaagaagcaaagaagggctgctccttacgcggtatgatccggaggattctcttatcgatgcctgtaatctgggaacggcggggcagcagttttttgaagcatacgatcaggcgaaaagaatgggactggataaaaagaactggctggatgccgcttttgaaatctgtgatttcgccatgtccagacagcgtctggacggcggtatcggcatgagctggaacagagacggttccccccatgagctgaaggggacggccggagcctttttaatcctgcctttggcggaagcctttctgcgtaccggtgaggacaaatatagtattgccgctgtgagggcttattcttactattacagggaattcgccaataacggctatggaacaagcggggcgctggatacctgctgtatcgataaagaatcggtgattcctcttttaaaaggcgggctgcttatgtacagggcaaccggttttgataaatatctggagatggctgaggaagctgcttggtatctgtctacctggcagtggcatcagacagtgagatatcctgcggatacggtgctcgggaaaatgggttatgataccttcggaggaacggcggtttcctcctcccaccatcacctggatccctttgcgctctgttatgtgccggatttgcttgagctttctgaacggaccggcagggaggaatggaagcagagagcccttgccatatggagaaacggggttcaggggatttcagacgggacaatgcagctgctgcaggcagggcccaggccggctggaagctgtgatgaaggtattcttcatacacggtggggaaattacaaaacggacggtgagaatggcagctggggcagtattttcagtgtgacccaatggctcgttgcatggccctgtgcattccggctggaagtacttaggaaatgcggcaactggaatttactggatggcttattttaatgggggaaagtgtaatgattcaatggaagaaaaaaggattggatacctgtttttataaagacgggctgcaattggcaagggccgtaggggcggaaggctgtgaggatagttttgaagaaatagaaaccggtgtattctgctggaaaaggaaatgccgtcctgcggtacgtatggttatggagctgcgtgcggcatattctccggattttaccatgattccgggagtcaattataacggcaacgggtggggaaccttttgtgagtatacctcagaccggtatcacggggaaccctggcagtacggatggcacagggcttctgtggcggctatgacctattcggagaaggcactggaaggaaatttgatcagcgtcgctttattcggagaagaaaatggcggcaacagctgccagctatttgaagacaatggggaagaagtgcaccgtatctgctggccggagacggaaagcccgaaagccttgtacctgtacaggctgggtgaagcatggcatggcagcatggaaccgaaggatacctttatttcctatattgtactggaggaaaacggaaaagccaaattcggttatcgcagggctttggatgccgcatggaagctgaacgacagggagcggccgcttcctctttcccaggaagaggtttgggaagcaggcattgcctatgcaaagacactctacacggaggaagaggatggcttctgcggttttaatatcggattggcatgggaaggaaatgcatggaaaaaacgggaggtgaataaatacgagatcggctggtgcggccagaacgggatgctggcaaatgccctgttatgtgaggcgcttcattccggtgatagggaagcggagacaatgggctttggggtattggacagctggctggagaaagccatgctgccggttggagtggcagccagttattatgatccgggacaggacagatatctggaggcctgcgatttgggaacggcaggccttgcctatttcgaagccgctcagctttctgaaaagcttggcaggaacggcggaaaatatctccgggccgcttatcagatctgtgatttcgccgtcagggtacaggacgggaacggccggtttgcaaaatgctggcatgaggacggcagcgttgccataagggagggtaccgtcggtgcattcctggtgctgcctctgctggaaggctatcggcagtccggggaagagagatacttaaaatcagccataaaaggaactaagatatatctggaagaattaaagctccatggttttaccacggccggtgcgctggatattttctctattgataaggaatccgggattccgctgctgaaagcgtcgacagagctttaccggctgacaggagagaaggagtggctggaggcggccagggacagcgcctggtatctttccacctggcagtatacccatacctgtcatttcggcccgtcctgcatactggggcagaccggttatgattccttcggcggcacgcttgtatctaccgtccatgaggggattgatccctttgccctctgctatgttcccgaactgtatcagctgtggaaagagacaggggaagagcgttggctgcaaagagccagggcaatctggagaaatggctgtcagcatatatcggacggaaccctggtcattgacggcaaacaaaggccgaagggcagccaggatgaaagctatacggtgacgaggcagggaacccatggaaggaaagttaatccggaagctttaaggccggattccatcggaatcgcttcccagtggctggtggcctggcccggctccttccgcatggaagttctgaggcgtctgaaggatgaagcggaaatgtggaactgaataaatacagacatgtacatttgtctcgttggaagaaggaatatagaaagaaaaggaagagcagcttatgacagaacaaggtagaattttttatgtagacagtataaacggagatgattcctggtccggttttacacctgaggaagcctggaagagtctggaaaaggtaaatgaaatgatttttcagccgggggaccacatccgtttccgcagaggcggagaatggcacggcatgcttcgctttcagggaaacggaagcgcctggtcgcccattgcagtggaagtctatggggaaggcgggatgccccaaatacatggtgacggatgttatgcggcagttttgctggaaggcgtcagccattggagggtaaaggaactggccgtgacaaatgaagctgaaacccgcagcgtacgccagggaatctgcatctgcggcagcccgcaggggatcacagaagatattgtgattgaaggctgtgaaatcagccgtgttgccggtgaaaaccggagagcgagggatgtataccaaagtatgtactggaactccggaatttatgtgaccatgcccggacgttcttcggataagaaccatcttcatgatattatcatcagcaacaattacgtgcatgatgtgcttaccagcggcattcgggtaaaccagcaggaagactttatcaacgatatccatcatacgcatgtggtggtgagaggaaaccggattgaaagaaccggaagcgacggaatcattgtagctaactgtatttcccctctgatagacggaaatgtctgtctgaatgcaggggcgctgggaagcctggaggataccaggctgattgccggcatctgggtatgtgctgtctcggatgccctgattcagcgcaatgaggtgggaggtacccgtctgttcgaaaatgacgggacagcctttgatacggattggggaaccgcgggtgataccattttccagtacaattatacgcatgataaccagggcggcttctggctggactgcatgggaatcaaccggaaccgggaatgcggaaaaacaatactgcgttataacatcagcattgatgacaaacgctgcctgatccaggatgattacggcctgcccgcccacctttacggaaatttatttataaacagtgaggaaggtcctctgatctgctgccacaaggaaggagaatcccatatcttccggaataatatattccatttcgccgacaaacctattaacggatggcagaaatcctctttccaaaggaattggtatagcggcaataccgaattcccggaaagcgacagggaagcgaccggagatgtccctttctgcttttccggcctgctggataataagccggtttccagggaagaatgcgaaagctactggaaccttcttgcggctcttggggatgaataattccggcatgtaagaatggttcttatgagtataaatgaaatgatttttataaacgataatgcgtttaaataattgcttaatatttcattattaatatagactttacaaataccttatgctataatacccctacgggaggtgataataagagatgtcagataatgaaatacttcagcaaatattggctgttacccagtctttaaaagcagatgtgagttccttaaaaatagatgttggatcattaaaagcagatgtgggaactttaaaaacagatgtaagctccttaaagacagatgttgagtccttaaaaacagacatgaagactgttaagtcggatgtgcaggatttaaagtcagatgtccggacgctgaagacagatatgcaggatacgaaacatcggattacctctctggaattgacattggaaaatgagaccaaccgcaatatccgccttatagcagaaggccatttggatttaggcaggaagctggatcaggcgctgatggttgaaaatcaaaaagaaatgctgcttattcgtgtaaatacgctagaaaatgaaatgcgtaaattaaaagaacagatggttaccacgtcctgagaataaatcaatactatcgggaatgtaaatccttaaaaagaatttgcattctctttttttgtaagaaaatagtaacggttcagatctgtctgaactttaccagaaaatataagaaacagcatcattttaaataacctgcttgatttattcttcatgtctggataaaataaaaaataggtctatagtagtatgagattaaaaaaatgagttgacgggggataatcctttgaattacaaaaaaatgaaaaacctctttctgagacaatcctatctggattcgtgggaagactatgagaacagcctgagaaagcccagctttatcaaatgggattatatcatccttactgcgtccaatgaagaacaggcgcgtacgtaccgggaacagatcgactacaggctggcccaggggctgcttcccgcaggaacgcactatgcggtgcttcccgatccggatggcaagcgggtgggatccggcggcgcaaccttccatgtcctgaaatatattgcggaaaaagaacagcaggagagagcggctaatctgtttaagaaccgccggatattggtaattcattcaggaggagacagcaaaagggttcctcaatactcggcctgcggcaaactcttttccccggtaccaaggcagctgcctaacggctatgcatccacgctgtttgacgaattcataatcgggatgtcaggcgttccctccagaatccctgaaggaatgctgatattatccggggatgtgcttttgctttttaatcctctgcagattgattttaactatcatggggcagcggctatttctatgaaggaaaatgtattgaccggtaaggaccatggcgttttcctgaatgacggcaatgactatgtcggtcaattcctgcacaagcaaagcgaagaacgcctgcgggagctgggagctgtgaacggacaggataatgtggatctggataccggggccgtgataatggattccgatctcctttatgccctcttcagccttatcagtacagacggccgttttgacgatgataaattcagggaatttgtcaatgaagaagccagaatcagcttttatggtgatttcctgtatcctttggcccgatcctccacattggaacagtattacagggaggccgcggaaggaacaataaatgataagcttctcgcctgccgcaggaaaatatgggaggtgctgtcgccttattccatgaagctgctgtgcctgtctcccgcagaatttatccatttcggaacaaccacggagctgcgcaggcttgtgaccgctgacgtggaagattatgaattcctggactggaaaaagcaggtggctacgaccgcgccggagcaggctccctatgccgcgcataacagctatgtgggcaagcgtgccagggtttcggcaggagcatatctggaagacagctatattctggatgaaacgcagatcggacaggggagtgtaatctccaatgtaaaactgagaaatgtgtcggttcccgatcatgtagtgcttcatggcctgcgtctgctggacggaagatatgttataagaatttacggcgtggaggataatccaaagggaaccctggaaaagggcgccggctttttgggaacaagccttccggcatttttggaaaagaatggtttgacggcggaggatatatgggaaaacggcgagcattatttatggttcgccgctctttaccctgcggcggatacgatggaagaggctatcaggttatccctgatcgtgaaacggatggcggaaggcgcggcttcgtccgaagagcgggaagaatggaaaaaggcggatcggaagagcctgtattccagctttaatgaagcggatgtcctggctatcagcagatggcagcatgagctggaaagccgtatccttgccagcaaatttgtctgggccattgagggcggaagctattacaaggatgctctgggagtattcggcgctcacggcatcagctccgatatttatgagatgcttctggaggatgccgagaaagcggcattttccttgaaaatacgtatttactacgcgctggcccagtatatgaaggaaaaacgcatcaccttccatggaaagggatatgattctctggaggccatgtgttttggaacgattcagaaaaccatttatgacagcgcggcggcgaagctgccatccagccaggattaccgcattgccagggatgaggtagccgtagaacttcctgtgcgcgtgaactggggcggcgggtggacggatacgcctcctcactgcaatgaaagaggaggtgcggtgctcaatgccgcattgaagctgaacggcatatatcccattcagatccgggtaaagcgtctggaacagctgcatgtggaatttgccagtacggatatcggggcatccggcagcgtggaaaccgtggaagaaattcaggactgccacaatccttatgattcctttgcccttcataaagcggcgcttatagcctgcggcattattcctctgcaggggggaaatctggaagaaatctgccgacgtcttggcggaggcatcagcctttccaccagagtagtgggaatcccgcagggctcaggactgggaacgagcagtatcctgtccggagcctgtgtgaaggggctttttgagttcctgggcagggaaacgtcggaagaggagatttatgatattgttctgaacatggaacagattatgagcacgggcggaggctggcaggatcaggtcggcgggctgagttccgggattaaattcattacttccatgcccgggattgatcagaaaatcaaggtggagaaggtacagctctccgagaaaatgaagaaggaactgcaggaacgttttgtactcgtttataccggacagcgcaggctggcccgtaatctgctccgtgatgtggtgggaggttatctgggaggacgtccggaatccattgatgccctggaaaaaatgcagaatctggccgttctgatgaagtttgccctggaaagagagaatctggatgcttttatggatctgctgaaccagcactgggagctttccaagcagctggatgccggatcaaccaatacctgtattgaacagatttttatggcatgtgaagatatgatagatgcgagattcattgcaggggcaggcgggggaggcttccttcagatgattctgaaaaaaggaattacaaaagagatgctgaaagaccggcttcatgaaatattccaggaaagcggcgtggatgtctgggacagtacctttgtataaagaataaggaaatgcagagagcgggaaggtttatctttcccgctttttgcatttctgatccagaagcttcttcgcatcctccagatgttcacggcatagaatgcggtaatgaatccatccgccgtcaccgcatggatacttcccgtcaataacttctttcgtataaggcagcaaatcatcataaacagcctcatactgtctgttatccattctcagcatcagttcaaaagcctgatcctcggcgaaaatatcacagatatgtttactttttatgctgtgcttgactccccatccgtaactgttaccatagggaaaacggattagagtctgtgtgttccattcttccgtaagatagctgttcagttcctgaaacagagctccgttggcaccgcagtaagcgattaagtcctccatggaagggacttcctgtttgttcagcattttttcatacatgggcggcctcctgtattttcttattcgcattttaattcagtatagcataataaagctgacaacaggtgtcatattatttattttcctttacaaattattttatttatgataaaattctattaccgaccgacaatctgtcggtcggtaattaaaaagagaacaaattttgctgttcatataggaatatgtgattgtatacacagacaggagaatacaatgagagtggtaaaggaagcggaagagcgcagaaatgaaatactggatgcggcggatatgctttttgccgacaagggctttgataacacaagcaccagcgatatcctggagaaggtgggtattgccagagggactctgtattatcattttaagtcaaaagaggatattctggatgccctgatcaagcgctgtcaggaacagataataaacgctgccggggaaattgccgcggataaggggattccggtgccccggcgcattatcggtgtggtacgcgccatgagtatcagccatgacagcggtaaggagatgaagaaacagatgcataagccgcagaatgcactgatgcaccagaagtctcaggcggctgtgctgaagggtgtgacaccgattcttacggaggtggtgcaggatggcatcagggaaggactgtttttcacgccttatccccgtgaatgtatggaaatgctgctggtgtatgccggaaccgtatttgacgatatgatggacgatacacaggaagtacaggaacagcgaatccgcgcttttatctttcatgcggagagaatgctgggagcggaaagcggcagccttgagccggatatgctgcagatgttcacagacgggcccgctgcctgccatgacagctgtcctgccgtatcaggataaagccgtcaaaggacttgaatatgcgttcaggcgcgtggataggagttagaatgatatttaaaatgatccgtaatgatctgactaaaaataagataattacgcttgcagccactgtatttattgccgctgcggctttgcttgtttcgctggctgcgcttcttgccattgatctggcgggagcggtggatgccttaatggagcaggcacagacgcctcattttatgcagatgcacacaggagatttcagccgtgaagccctggaacagtttgctgcggaaaacgaaaatgtggagagctttcagataatgccgtttctgaatatagagggcggaaagatacgattaggagataatacgctgtcgggtaccacacaggataacggactgaccatacagggaacaaattttgactacctgcttgatttggacggaaaccggatacagccacaggaaggggaaatatatgtaccagtctgctatatgcgcgataatacggcaagtctgggagagactgccgatatcggaggcatttcattccgtatagccggctttttgcgtgattcccagatgaattccatgctgtcctcctccaaacgttttctggtgaatcccagtgattatgagaaagcggcaggcctggggaaggaagagtatctgatagaattcaggctgaaggagggcacggacccgtccgccttttccaatgcttatacggcggcgggccttcccgcaaacggccctgcgatcacgtatcctcttataaaaatgatcaatgccatgtcggatggcattatgatcggtttgcttctgctggtaagtattctggctgtgctcatcgccctgctgtgtatccgttttacccttttgtcccagatagaagaggattaccgggagataggagtgatgaaagccatcggcatccggatttccggcatgaaacagatttatctcataaaatatgcgatattgggcggcacaggctgtcttgccggttttctgttttccctgctgctgcgggaaccgatgctgggaagtatcaggcagaacatgggggatgcgggaaaaggctccctctctctggcagccggattctgcggtgctgcgatcgttttggcggttatccttaattttgtaaacaaggtgctgaatcgtttccgtaagatatcaccctcccgggccatcggctttggctttgaggaagagtcgggcggaacatccggccgttttttccacagaatcagccgcctgcttggagtgaatgcggcctatggcctgcaggacgttgtatcccggaaaaagatatatgcgactattctggccgtgcttgttttcgcagtcttcatcgttgtcgtcccccggaacctgtacagtactattgcggacgaaagcttttccacttatatgggaatcggggactgtgatctgcggatggatatccagcagacggatgctgttgcggaaaaggccggaagaataggggaggaactggaaaaagacaattcggttgccggttatacggtgcttcataccaaaaacttcactttgaagaatacggacgatgaggaagagagcatcaaaatagaattcggcgaccataaagcattccctgtaacctatgcgaaaggcgatgcccctgtttcggagaatcaaatcgccctttccgcccttttggcaaaggagcttggaaaagaggttggcagtacgctgacactgcgcacaggggcaggggagaaaaagctgacggtatgcggtatttattccgatatcacaaatggaggaaagactgcgaaggcagtttttgaggacacggatgcggatattatgtggagcgtggtatatgcaaagctgtccgattcctcttcggcggcggaaacggccctccgctacagggcagaattcccttttgcaaaaatcacggatatccgggaatatgtatcacagacatacgggcagacactgcgatcggtaaattgggccgctgatgcagccgcggccgccgccgtactcatcacagcgtttattactctgctttttgtcaggctgctgatagcgaaagacaggtatgcgattgccgttatgaaggcagccggttttaccaacacggatatccggctgcaatatatattccgtctgatatccgtaatgcttgccggcattcttcttggaatccttcttgccaatacggcaggagaaaagctggcaggagcggtactttcctcacttggcgccgcctccttccattttcggataaatccgctgtattccttcctgctttgcccgttatggatggtctgctcggttcttggggcggccttggccggagtacaggcggtgaagaggataaatactggggaacacttaaaagaagtatagattggatgccatttggcacagaaggaaaagcaaatgaaagagatcatcagcggaaaaggcatcataaagacatttggacagggtggggaaaaaagacgggtattggacggcgtggacatatcggtggaggaaggggaatttatctctgtcatgggcccctccggttcagggaaatccaccctgctgtatgcctgcagcggcatggacagcattgacggcggaaacatatccttttgcggcagggaactgtcatcattcagggaaaaagaacttgccgatctgcgcaggacgcggatgggttttgtattccagcagccctctcttttgaaaaacctgaatatcctggataacatcgttttcccgtccctgagggatcacagaaaaaacgccggtcagttaatggaaagggcgaaagaactgatggaaagaaccgggataagccagcttgaaaaaaggaaggtcacccaggtttccggcggccagctgcagcgagcgggaatatgccgtgctcttatgaaccagccggaaatcgtttttggggatgagcccaccggggccctgaattccagggcatcggcagaaatcatggatcttttctccgagattaatgaacagggaacggcagttatgctcgtaacccatgatgccgcaattgcggcgcggacccgccgcgtcctgttcttatctgacggccgggttgcgggagaattgaggctgccccggaattcgggcctcagccatgcagccaaaatggataaagtattggaaaaaatgcgtctgctggagatctgaaggtttcctgccaggtacagataaaaaaagcgccgcgctctgcctgaggttctttctcgcgtcagggtattcatcgtccgcgctgtggccttacgctccccactttcctttggcctgtgtccggccaggtgctttgctgttcggcatgggcagacaaaaaaaggggctgtttctaactatttcctttccatactccgctgccaacgcggcttaaactcctccctttggtcgtcagacagcaccgctagggacggcagcagatcatagaaagaaaatagtaagaaacagctccctttttttgagatgcccatgccgaacagcaaagcacctggccggacacaggccaaaggaaagtggggagcgtaaggccacagcgcggacgatgaataccctgacgcgagaaagaacctcaggcagagcgccgcgctttttttatctgtacctgacgcctttgtaaggaatcagcggatactccgggccatttccagcagtctgggataggcataggaaaagaagtcctgatagctttcgcaatagctgttcagtcccggtgtcctgccgtcggagaggagggttctgtcccggcggcagccgttccggcataagggataccagcggcattccttgcatttatcgggaacattgcgggataaactgacaaaatccaggtcttcccgggcctgattcatttcttcaaaggaattgctgcggatattgcccagcttccagtcatccaggacataaaaatcacagggatagacgcttccgtctgcctcgattacccattgctccgaacagatacccatcatattgcaggattccggaggataattgagcagcattccgacccagttttcaaaggtacggttatataccggatgcccgtccttccagtcctggtaccaatagtcaaaaagatccttcagaaatttcccgtaacggtcaggggtgagggaataactgagactgcctttgttttcttcaaaaggatcaatacagggtatgtactgctgataagtgaagccctgttccccgaaatactggtaaatccgtttaatccgcttggaagactgcgcggtaacaacggtgagaatattgaattccacctgatattcctggaaaaggcgggcggtttccataacccgggcaaagcttccgctgttatcaggaaatttccggttttcatcatgcagctgctcgtacccatccagagataagcccaccagaaaatgattgtcatgaagaaagcgtgcccattcctcatcgatgacaattccattggtctggaggctgttatggatttcaattcctctgtgattgtgttttttctcaatttctgtcagcgccctgaaaaaatccaggccggccagggtgggttcgcctccctgaaaggcaaaggtcgccgtatgagtcacctgattcagcgtcttttccacgagaatatccaaagtctcttcggacatcattccataggttttttccttacggttattcatttcatccgcataaaagcaatagcggcagcggagattgcagcttccggacgcaggtttgatcaacagggtaatagctggctgttttggcatggtaataactcctctcgatgtatataaattcaggatataacaaaatggacgtcttggcaaccgtctccgaagctgcggcacatctccatgaagcgcagggcgttttccgtcaggtatttattcttatgataaatgatggaaaagcttcggtgcagggcgggggcatcgaagggaatccgggagataattccctggttcagggcgtccgcagccagcaggcagggcagggcggagataccgatgttcctgctcacagcccgcacaagggactgcgtgctcacactttcccatacgatatttataggcagctggttataattcatcagatcctccgcggcctccctgccggcgctccctttttcacgcaggacaaaaggacaggcggaaatatccttaagtatcaccttgtttttcgtaaggagagggtgccggggagaacagataaagcagatacgatcctcaagaaaaggctcgctgacgatgttgggatgctgggtattgccttcaatcaaggcgaaatccaggcggttgtccagcacggcgtcttcgataaaaccggaattatttatggtgaccttgggattaacgctaggcagctccctggtatattgctgaatgagcgcgggcaggagaaaattaccgatcgtaacgctggagccgatccgcagagtagcggactgcttccaggcaggaattttttcttccatttcatcaaacagcgatatgatatgcagcgcgtagtcgtagagctgttccccctgctctgtgatgaacaggcgtctggaaaaccgttcaaacaaacgtatcttatagttctcctccagctcacgtatcgcaaggctcaccgaaggctgtgcaaggtgcagccgatccgctgccctggtaatgctccgctcctgatatacagccacaaaaatccgaagatgacgcagtgtcataaattctgcctccctgtgctaattcataataaaatggttatgtaatatataatataatactattttacttatataacaagtgggggtatactttaccataacgagtgggttgcctttcacatccgccctgtgctccgtgtcttccctgcgccgttttctcttccgccagccgttctgccttcccgttgggtctatgtaccctgcaaaggccttctaaaaacgccggtccttagattgcgttctgtgcaatcttagtaccgctgcgtttttagcagagtgagaacgtgcctgcgcagggtacatagacccaacgggaaggcagaacggctggcggaagagaaaacggcgcagggaagacacggagcacagggcggatgtgaaaggcaacccaacaaagaaataaggataagaggagttggcatggaaaagaaaagtaaggtgctgagaaaattatttttttcaaccctgtatctgagtacctttaccttcgggggcggatacgtaattgttacactgatgaaaaataaattcgtggatgagctccactggattgatgaggaggaaatgctggatctcgtggcaattgcccagtcatcaccgggagcgattgctgtgaacggggctatcgtggtgggctacaagctggccggtattcccggggttctgtgttccattctcggggcgattctgcctcccatgatcattctgtccctgatttccctttgctacgacgcctttcgcaccaacctgatcgtaggctccatgctgaaagggatgcagtccggcgttgctgcggttattgcgtcggttgtttatgacatgggaagcaaggtagtgaaggaaaaggactgggtgaatatcgtgattatgggcatcagctttatcgccagctacttcttcaaggtaaatgtggtattgattatagttgtggtcgcctgcatcggcgcggttcgtactctcatgaaagagagaaagggggtaaaggcatgatttacctccagttatttttgagctttcttcagataggcgctttcagcttcggcggcgggtacgctgccatgcctctgattcagagccaggtagtggatctgcacggatggctgacgatgaaggaattcacggatctggtcacgattgcggagatgacgccggggccgattgcggtgaattcggcaacctttgtggggacacagattgcgggacctctgggcgcagttatcgccacattgggttgtattcttccttcctgtatctttgtaaccgccttggcctatatctatatgaaataccggaaaatgagcatgctgcagggaattctcggttccctccgccctgctgttgtagccatgatcgccaaggcagggctgaccatcctgatctcggcggtgttcctgagcggcgctgtgaaatttgctgcgggcaatgtatctgtccgtgcggtgatctggttcgttatcgccgtagtccttctgcggaaaaagaaaatgaatcccatattagtcatggttttatgcggggtgtttgaaacgatatgtgtgctggtgatgaaatggatataaggaacctctttaccataggggaaatgggcgagctgttccgtatcaatatccggacgctgcgctattatgatgaaatcggcctgctgaagccggaggttgtggatgaaaggaccgggtacaggtattattccgccagacagtttgagcggatgaataccattaagtatctgcgcaccctgaatatgcctctggacaaaatcaaggccttttttgagaacagggatacctccgtcatggaacagattctggaggaacagctggaagaaacgagagagcagctttccaggcttcattccattgaacggaagctttccaacaggctgtatcagcttcattatgccatgaccgctccattggaaaggattgagcggaaaacctttcccgcccgtcctgcggctttcctgaaaaaagaaatctctcaaggggaaagcctggaatatcctattcgggagctggaaagaaccagtcagcttcctcctgccatgtttctgggaaaggtgggagtgtccatcagcagggaggatttgctgaacggccggtttcatcacttctccgggattttcgtccttctggaagaggaggacaattaccggggggagcagacctggctcccggaaggggattatcttaccatcctttatgccggaacccatcaggattctgccgcctattatgaacggctgctggcctgtgcgcgggagcaggggctggaatgcagcggggattcggcagaaatcacatggattgattcaggttttacggatgatcaggaaaaatatgtgactgagctgcagattcccgttgtcagccggacatccggcggctatactgaaagtatcggaaaggttttctgaaaaatcaggttaaaggggaaacagaatggaaagagggagtagagctgacgggaaagaaagctgcagtacagcatggatactccgtttccgggtaccggacacggaaggcattttcttttccatggaagaagagggagaaaggttcctcctggaatacagggaaggaatcctaaaagctgttatccgcttctccgcaaggccggaaccggtaacgctggccggaacatgcaggccgggaaatgaggctgtgcttaattttacgggcttcaggctggaactgctgacggaaggggccctggcggatgaggactggacgattggccgggtggatattgccgggatttgcggccggggaaaggggctggaactcaggccggaattgggcaggtgcctgataagggaggaaagggaagaatcgtttaccgggatacagggatggaaacccgaagggaagaatgtccatcttggggactgtatgcctttttatcacgacggaacctttcacctgttttatttatttgaccggagaggacacaaaagcaaatgggggcttggtgcgcatcagtgggcgcatgttgcttcccaggatctcgttcactggacacagtatccgctggcgatcggcattgatgatgaggcagaagggtcgatctgcaccggatcagttatctttcatgaagggatttattatgcattctatgcggtgcggatgtgcgacggctctccggcccggctgacagctgctctgtctcaggatggaatccatttccaaaagagtcacagagtattcgccctgcagccgccctatgacggggcatcggccagggatcccaaggtgatccgggacgaaaacggagttttccatatgtttgtaaccacctcccttttacagggagaagagagcagaggctgccttgcgcatctgatttccggagaccttgttacctgggagccggtggaaccgctcgttgtcctggatatcagcgatcagccggaatgcagtgactatttcaggctgggggatttttattatctggtatacagtaatttcgggacggccaggtattttttctcggaaaatcccttcgggccgtggcaggcgccggatgaaaatgtggttgtggaacgttcctacagggttcccaaagcggcgggatggaaggatgaaagaattttattcgccggtttttatgtggacccggatgtggattatggaggaacggtacggttttatgatgccgcggcaaggaaagacggaagcctggaattcctgccggtaccggaaatggttgaggaaaaatagaaaaaagtaaaaaagtattgaccctccagtaactggagggtttaatttattttggaagtaagttacatagcggggagataaaattatggaatccaagaaaaagaaagcggaaaacaatctgacaaaagggagtgtgatccgtgtattattcaccttttccgttccgtttatcattgccaatatcatacaggcactgtatggggcggtggatttgtttgtcatcggcagatactgcggcccggaaagcgtggcagcggtttccacaggaacccaggttacccagatcatcaccagcctgattacgggtctgactctgggaagcacgatattggtgggaaaatatacgggaatggaagaggaagaagaggtaaaaaagacaatcgggacaacgcttaccatatttgccattgccgcagtgattcttacggttcttatgcttctttttacggacaggattctgtttctgctgaaaacgccggaggaatcctttgaattggccggaacgtatgtgcgtatctgcagcctgggcattctttttatctgcggctataatgcgataagcgcaatcctgagaggttatggagactccaggcgtccgatgctgttcattgccctttcctgtgtcctgaatattgcaggggacttcatactggtaaagggcgcgggcctcggcgtggcaggagttgccctggctacgattggttcccaggcagtaagtatggttacggcaattatttatttaaaccgcaggaagtttattttcaccttccggctgaaaaacttccggatcgatccggcaaaagccagagagcttgcctgggttggcatccccatatcccttcaggaatgtatggttcgtttttcctttctgtatcttaccagcgtgacaaaccggctgggaatctatgcggcctccgcagtgggggtggcgagcaaatacgatgtatttgccatgctgcctgcaacttcggtagccaatgcactggcggctgttaccgcccagaactatggagccggaaagccggagagggcgaagaaaagcctggcggcaggcctgctttttgcggtggcggcttcctcccttttctggctgtgggcccagctttcccctcagacgatgatcgggttattttcctcagatcctgccatcatcgaagccggcatcccttttttcaggacatgcagctatgattatctggctgtgagttttgtgttctgtatgaacgggtatcttaacggcagatcgcagaccatatttaccatgataagctgctgcttcggagcgttggccctgcgtatccccataatccatctggtgtatgccaactggccggacaacctggcccggatcggagcgatcgcgccgatggtttccggatttatggcagtttataccgctgcctatctgtgcatacagttttaccgggaaaaacagcgtatcccgggtgcttccggacagcgcggcatgaattgaaagaaacgccattgcagaaataattgcaatggcgtttcttatcctatataattagctgtaaaatgtatattccgatgtgaccggtgcggccccggacagtgatatcccgacggggaaacagcttatttaagaatcagctccacaacaggtaccaggctgttgggctttacggcaggaagatagagaatcaggtcactgctgtcctccgtttcgttctttgcagagaaatggtcgatggcgccttctgtgaaaagaagctcgcttccgtcatgaaggaactgggcgtattccacctttccggccatcccgggaagacgaagatgggcgaatggataggcaaacagatgcaggtacaggcggcttccgtcggcgctctgggtgtatcggcagtctgcgggagctgtgattccgggctctgccatggtacagccatagatagaacggctgttatatttcatccagtccgcatatactttcagtgcatcctccgcgcgggaatccagatagcctctggaggtagggcctacattcatgagcaggttgccgccgcaggacacggtatttaccagcatgcggatgagcatttccggagatttccaggtctgctcgtccctgtaatagccccaggagccggaaaaggtctggcaggcttcccatgttaccagttcgcctgtttccggatgggttacccatttgaccggctgatactgttcaggcgtccacagatcctgttcgatgtcggtacggttgtcaatgatgatatccggctgaagggaacgggcggtggcaataagcttttccgcttcccagtcatttttccctttgcccttcatccatgactgatcgccttcgccgtcctggccgtcataggagaaatcgaaccagagaatgtcgatcttaccataattggtcagcagctcagttacctggttcctcatgtactcggcatatttgtgcatgtcccgtccctggttcagctgcagggcatccgcgtcgtccctgcggggatgaagcgtgtcgatggggaaatccggatgatgccagtcaatgagagaatagtagaagcctacacgcagcccttccgagcggaatgcctccacatattccttgatgagatccttgccgcagggggtattggtagatttatagtccgtatacttgctgtcaaaaaggcagaagccctcgtgatgcttggtggtcataaccacatacttcattccggctgcctttgcctgtttcgcccattccttcggatcatacagatcgggattgaagtgtttgaagtaaagatcgtaatgctcctctgagattttttcattggttttcacccattcatggcgggcaggcatggcataaagcccgaagtggataaacatgccgaaccggtcatgggtaaaccagctggtatctccgggagtctggcgtgtaacataacttgtcataattcctccgttctgccgtatctgcggcattatcttttttaccgcctcatgtaagcgcggcaggtttatgggtttattgtagtgaaaaaaggggcggaggaacatgtaataataaggaaaaaatatggagttttaagtatgattctatcatcaaatccaaggccgcttcagctgtggaaaacgctcagcctggaggtggcagattccggtctggcccaggtggataatacctggaatatggaaaaggtatgctctccctattccagggtctatttcataccggaaggttccggaaccctcaccctgcgcggcagggaaatcgctttgcaggaggggtatgtatatctgattccagcaggcctgctgtataattaccggtgtgattcccatatggagcagctttatttccatgtaaatattatccaggtgaacggcatggatcttttcttcggctgtgaagaggtgtatgagagaaaagtctccgggcagtacctggaaagggtgcttgcgctttaccgttcccagcgcatgggggattctttctgccttcaggggattctgtgggaggagctgggcttctttaccaggatggccggcgttcaggaaacgcggaccagaatctattcagagatggtggagcagtttttcttgctcgcacaaaatccggtcagcgctaaaaaccatatccgcagcatggccgatcggctgcatgtttcggaaagcacgctctccaaaaaattccgggcggaaacgggtatgtatccgggaggctatctggaacagctggttatccagaaggcctgccgccttctcctgcaggaggacagaagcatcgcgcagatagcggaagaactggagttttccgaccagttttattttgccaagtattttaaacggctgatgcagatgccgcccagtatttaccggaggaagatgcggggcagctgaaaaaaagacaggaatgacagacagaatggagaaggaaaatggtgaatataatttttgaactgatatggtacttttttatttattcctttatcggctggtgtgcggaaatcgcatatgccgcggtaaagcataagaaattcatgaacagggggtttttaaacggaccgctctgtccagtatatggcatcggcatggtgctgatccttgtcttcttcagttctctgaagggaaatttctttttcctggccctgggctgttccgttatggctgccgtggtggaattctttacgggagccctgatggagaaggtattccggtgtaaatggtgggattatacaggctataagcataatttaggaggatacatatgtccgcagttttcggctctgtggggaatcggggcggcgctgatcatcaccttcgtccatccatttttggcaccgcttatttccatgataccgacctttattgtcaggcttcttggcataatcctgcttgtgatcaccacaggggatttcctgtcggtggccggagccatcctgcagctgaggaaaactgcccgtattgaagaaatagcagcgggaatgcaggaggtttcagaccggctggggaacgctattttccatggaatccaaaaacgtatgaccagggctttccccaatctggaaaaggatggggaaaatgcgttggcggcaaggttccggaaaaaggagaggaaagaaagccttgtattcgcagaaggctgcagtttccacaaactggtatggctgttttttatcggcgcatttctgggggatattacggaaaccatattctgccgtctcacttcgggagtatggatgagccgcagcagcgtgctgtacggccctttcagtattgtctggggaatcggcgtggtagtgcttactatgatgctgcataaataccgtgacagggatgacagatatatctttattttcggcacggtggtgggcggtgcctatgaatatgtatgcagtgttttcacggaaatggtgttcggcacggtgttctgggattacagtaaaatcccctttaatctgggaggaaggattaatttgctttactgctttttctggggactcgcttccgtgctttggattaaaaatgtatatccttttctgtcccgctggattgaaaaggttcctgaaaaggtcggaaaaatattgagctgggtatttcttgtgttcatggcagttaacattgtgctgtcagggatggcattggcccgttacagcgacagatacggcggaaagcctgcggaaaacagtgtggatagcttcctggatacccattatccggatgaacggatggaacgtgtttaccccaatgccatcataaaagaatagctatgccttcgggaaatcagggctgacggcagaaaacttctcttcggtcggagtaaataccgggcctgcacagctgcccgaagccggtcaccccttcccttgcggcatccattgattatatggaaaaaattattaatcacattatgtagtaatgaatgatttataatagagtgatgaatggaaggttaggttatggaagaaaaagataaagagtactcgatattgcaaaattttgtttattgtataaaggcaactattcaaaattacccaaagttattagttctctgcgttagtttaattgtgattaatgcggcgattcctgtaataacgacatttcttcctaaagttgtaattgatgaaatagttaatcagaaacctttagagcatttaatgtttgcgacagggctttttttaggaactattattataatgacttcgttgcagaaatatatagacagattgatttattggcataagtataaaatgaatacgtattttctgaagatggtaactaataaatcattaagaacagactattgtaatcaagaggacgaacattttagaaatcttcagagtgaaagttttgctagttgcaatggtaatttttcatattatgcccagatttatgatacttcagttggatttatggcaaacttactcggttttgtgacctttttttatgttttgataaggttgaatataataatagtattttttttggtgatttctacattagctagttattttatgaataaaagaataataaagtgggaaaaagttaataatgaggaaaaaattagttatactcaaaaattacagtatattacgaaggtgtctggagaaattaaagccgcaaaagatattagattatataatatgattgcttggttaaatagtgtatatcgcgtgaatatggaaggtgtaaattcatggtataaaaagtatgcttctaaaatatttaaagtttcgatatgcgattgctcgttttctcttgtgagagaaggcgttacatatttctatttgttatatcttgttttacaagggacactgacggtagctgattttgtattatattttaatgtcattgttggattttcagcatggttgaatagcttgctaggacaagttaatacaataaacagattaaatgtatctataaataggtttagaacgtttgtagaatatccggaaaagtattgcagaaattcgggagaaaagatacatgattttttaaagccacgtactattgaactgaaaaatgttagttatcaatatagtggtgaagatagcaaagtaatcgatgatttaagtttaactattaatccagggcagcatttggctgtagtaggtttaaatggagcgggaaaaacaacacttgtaaagcttatatgtggattaatagatcccacagaaggtcaagttctgtatgatggaaaagatttaaaagagttggatagggatgatgtgtataaggcgtttggagttgtttttcagcaatattctattctacccgtaacaatagcagagattgtggcagagaatattagagaaaatgtaaatgtcgatagagtaaaaaaatgtttagaacaagctggattgatcgagaagataaattcgcttaaatatggtttagatacaaaatatgataaaacaatgtgggaagatggtattgatttatcgggaggggaaaagcaaaaattattattagcaagagcattatataaaaattcgccgatagttattttggatgaaccaacggctgcattggatcctatttcagaacaaaatatgtatgaattatacaatggagttatggattcgaaatcatctatttttatttcacacagattggcctcaacacgattttgtagtcatattatattgttagaaaatggaaaaattatagaatgcggaacgcatgatgaattgttgagccttcatgggaaatattatgaattattcgaaacccaagcaaaacattatagagaagaaaaggtagatgaatatgagcattcgtgatcgtttaaaaataaccaggcgaggatatagtattttgagagaatattgtcctggtcttattgaaactaaaattttgtttacattgattgaatcgggttctccctttataaatatatggttttcggcaaaaataataaatgaaattgcaaatttacgacgaatcaaagttcttggtatatatgtgatttttacgatacttattaatttgattttttcgattataaaaagtgttgttgaccgtgtgagtagtgctaaagaagctagtatgtgggattgcttctcaaagatattttgtgataagcaaatgagtgttgaatatgaagttttggaaaaagctagttatcaacaacaaaagcaaaaagctgaggaaaacttatttatgtttggaaatggtctgggtcagttggtgtggaatacgcctggactgataagggtatttgtaggtatttttgcttcgattgcattatcgatatctttgtttactagcaaatgcaataataatatacttaattcaaaattatggattttagtaatcgtggctatgattgtttttgaaggctggattcatgataagtataaaaacagagaacagaaggtttttaatgattggagcgatggaacagtttggtttaacaggacatttgcattctatggtcaagaattagatttagatttgcagagggcaaaagatgttagaatttatagacaagacattattgcgcttaataaaattgataaaatgatagcacataacgtaaaagatgataattatatttcaaaaatgagtttatatcaaggtattagttctttttgggcagaaataattaattctctatgctacatctttgttgtgttaaaaactttttacggtgcatttccagtaggaaatatggttcagtatattagttcattaaaaagattaacagagagctttggtgagctaacattatcaattgcggaaaataagatttattgtgaacatctaaaaaaactatttgaatatcttgatattgatgctagtaatgaaaataatgtagatatcttagaaaatgttgttgaaaaggaaatctgtatagaatttaagaatgtttcattcaagtatcctggaagtgatacgtatgttttaagaaacattaatgcggaattccatagcggaaaacgatatgcgatagtaggaatgaatgggtcaggaaagactacgtttgttaagttgttgtgtagattgtatgctccaacagagggagcaatttatataaacgggattgacgttaaaagaattgattacaaagagtatcttaagaatttggcggttgtatttcaagattttcaacttttctcattcggcgttggacaaaatgtttctgtaaatacagattatgacaaattgaaagttgagcagtgcctaatgaaagctggggtatatgatagagttagtaagatgtcagataaattagaaacatgcttatatagggatttctcagagaatggcgttgagatatctggaggtgaggcacaaaaaatagcattagcaagagcattatataaagaagcatcagtaatgattttggatgagccgacagctgctttggatccgatagctgaggaagaaatttatacaaagttcagtgaaattagaagtgaaggattgacaatttatattagtcatagattgtcatcatgcaaattctgcgattctgtcaatgtatttgattgtggtactattgttcaaaaaggaactcacgatgaattagtagcaaataaacaaggaaagtattatgaattatggaatgcgcaagctcagtactatcgaaattcttccagataggagagtgccttatcagtaattacattggtgatatattggcttgaaaaggttacttttccgttttccttcaggacatccgtatcggtgttgcctgcacagcccatggcccaggcaccctgatcatccgtgagtataaaaagaatatttgtttttttatgttccatacatggaaatcctttctttcagagtctggtacatatgcagcagcaaacaggaagccgcatagcttcctgtctgctttttcagggaagggtaaagggattattttccaagctgtgccgcgatttcttcaagcagagtattcacgccgttgtcttccagcgctttctggaatttgggaatgttttcgtccggatccaccatgcctgtctccaaagccttcgcatattcttccacagtacttgtgagtgctgcgatttcagattccacaggggcattatcgaaggtaaagccgttatgaggagcggttatagcggattcattgtattccataaacaaatccatgatattttcaggataggagatatcccatttctggttaaacggagtgccgaactgccagccataggtgtaatcatagccgttgtctgcgggatccagggtaccgcccatggttctgtcaacctgcttgtcgccgacagcagtgtagtgttcgccttcaataccgtggcggatcagggttcccacatattcgtcggtattcagaagattaatgaattccagggctttttccggatatttggatgcggaagaaacggcaagcagtccgcccatggcgtttctggtttcaaacaaaggattcatgagaggtacaaaggtcacgccgtggcccgtttttgcagcctcggattccgctgcgcccggcgcataggaaattacataggagaacagggtgccgttcttgaagtcattatccctgtttgcagtatcggtatcatagtttacaggatccttggaaagataaccatcgttataccagccgcgtaccagtttgcagtaatccatgtattcctggcttgtatattggttgaaaatttcctcttcgccctggaaattgccgtattcagcaaccggggaagcgccgggaagcttgggatctccggtaaggctttcaaagggagtggttagaccaaagttcaggccgctgacgccgatgacatttttcccggcggcagttgatttttcatgtacagtgtccagaacctccgtataatcctccagggtcttgaccttactcaaatcgatgccatattcgtccgccatatcggaatttacaaaaaatcccgactgccagcccatttctttataggaaggaacgccgaatatttttccgtcgacagccgccgctttccagagcgcttcaggtataaaatcgtaggtttccttcgcatattccgggagcagctcagtgatatccaggaaagcatcttttgcggcaaattgcagatagtttgtagtccagttagaagtaaagcagatgtcaaaataatcgccagagttaatcagagtgggcattttctctttatagtccgggttggcgataaccgtataatcgatttccgctccgattttttctctggtgtactcattcagcttttcaataaccttatccgtatcgggggccacagggttgatggacatataccatttcagggttacgatttcatccgatgtgttacccttgtctgcgccttcttcggtagcaccggaagcttccgattctgtcccggccttttccgaagccggttcggaagaggcggcgggagctttactgctgccgcagcccgcaagcagcgaagcggcaagaagaacggagagacctgtactaatcagtgttttcattttcatactcatttcctccatatttacatagttttttgcagtttatttattaagtgcggtttggccgcatctcataaatcagattcatagccggcggagcgcttatccttttacgccgcccaccgtaaggcctttgacaaagtatttctggaaaaagggataggccagcatgacgggaaggactaccaggaccgtcagggccatacggccgctgtccgtgggggcgtttttagccatttccgcgtactccagcgcattggcggaagactgtgtcagggcctccagactgttctgcatgctctgaagcagcgtctggatgggatatttcttggtttcaaatatataaagcatgccgagaaaccagtcattccagtaggcaattaccgtgaacagcccgattgtggcgattcccggtttggagaggggcagcaccacacggagaaaggtcctgaattccccggccccgtcaatatgggcggcttcaatgatttccagaggaatgcttttaaagaaggtacgcagcacaatgacatagaaggcattcagcgacatgggaaaaatcagggcccataccgaatccctcaatcccagaagctgggtgttcaccatgtagctgggaaccatcccgccgttaaagagcatggtgaaaagcagcaggaaggtaaggattcttccatagcggtaatccggcctggaaagcacataggaaagcatggtggttaccgcaaggctgaacagtgtgccgaaaatggtgacaaacagggtgatgccgtaggaacggatgatctgatccccaagccgcagaaaaaagcgataggcgttcaggctgaattcggtgggaaaaaaggtatagccgttacggaaaatgctttgctcgctgctgaaggatacgatgacaaccagaagcaccggaagtacacacagcagggcaaatgcggcgagaatacacagcaggagcacattggtgcgcgtgctgatggcattaatccgtttttctttatgaatgacagcagatgattttgacatatccggcctccttaaaataatgcgctgtctttgtctattttacggacagcgaagtttgatgacaggaccagtacaaatccgataagagactggtacagattggccgcggccgccattccgatattcccgttttccttcagggagcggtacacataggtatcgattacgttggtgaccgggaacagcgggcccgaattacggggaagctggtaaaatagaccgaagtccgcatagaatatttttcctatggcaagtatggtcaatacaatcatcatgcttttcagggacggcagcgttatgtatttgatctgctgccatttcgtggctccgtccatcagggcggcttcgtaataatcgttggaaatacctacaatggagcccaggtacataactgtggaatatcccagtgttttccagacttgaaagatgatcaggataaagggccaggcagatttctgtgagtaccaggttatctctgtcccgaaagtccggttgataaaaccgttgtccacactcaggaacgaataagcgataaaggaaaccaccacccatgaaagaaaataaggagccatgaataccgtctggaacaccttagccgtttttttctggtgcagctcgttcaggacaatggccattgtgacggcaagaaccagatccagggcgatgaacaggagattgtatcccaatgtattcctcgtaataatccaggcgtctttggttttaaacagatactcaaagttcttcagcccattccaggcgctgccgaagatgccgtcccggatgttgtactttttaaaggccagtataatacctgataacgggagatatttaaacaggaccataagcaccactcccggcaatgccataacagtcagcggcagatttttcttaaaataaaaccaccggctttttttgtttgcgttcataaagcctgcctccttaacccataggatgttttctctttgtacattaattgtaatggacttctcccgtaatccacaacgcgaatatttttagctggggtggattctttttctgaaaaaagatccttcgggcagaaggaagcctctttaataaaattcccttattcgctcaaaccatatcccggcaggatcctttgtctccttcatatacgcgctcatccggtccatcagccttcgtttgattccggcgtattccttatcatagcacacatttttcagcatccagggatccttttttaggtcatataattcaccccgctcattttcattaaaggtaaactggtaatccagatccctcaccatccgctgccttgccgtataaaaatgatagtgatattcgcagaagatatccttccttccattatccctgatgcggccctccataaggccggccaggctttccccgtccaccttttcgggaggcttcgtccctccgatttccagaatgctgggcatcagctcctgcagcagcacgaggctgtcattgtcctttgtaccaagcccttttaccacaagaggcacccgatagatttcatcaaaggtaaaagcccccttttcaataagcctgtgcgctcccatgcaatccccgtgatccgcactgtaaataatcaccgtgtcctcataaagcccgcattccttcagtttatccacgatcatccccacgcagtcatcgattaaggtacagtgcccgaaatacctggctgagatttcctgaaaaccgctccagccataatctgaaagcccccacattttctccgtcaggtaatatccgtagggcttatcatgaaaatcctcacagtagctgggatgctccgggattagcttcggatcatacatggaataataaggttcaggaacaatgctgggactgtgcggcccccagaagttactccatatgaaaaacggctgatccttttccttcgccttgtcaatcagacggtttgtctcatgggctacgaaatattcgatggtgctttccacagggccgtcatgccggcagaacatttcctggatctgcagcgccgggttgtttcccataaatccctgagaaacatccacaccctcaaatccgttttccttcagatattcttcataataatttggggtattggccggaggaagatcaaatttcaggctggggaacacccggcttcccgggaaaccgtatcccatgaagggaagattgtcctcaaaaccacagtccgcgggcgtcatggtcggagaaacatgccattttccggcgtatccgcagtaataacccgcatccgccatgcattggctcagaagaggcgtcccttccttaatatccgtataattgtcgatgaccccatgcttatgggcatacagccccgtcatcacgctggcccgtgagggggcacagatggcggaggtgcagaacgcgttccggaacttcatcccttcctcagcaagccggtcaatgtgcggcgtcctgcagatacagtccatcccataagcgctgatggtgtccagtctctgctgatcggataacaatagcagtacattttttcttttacccatttcatagccctcctttttctatagcttcattgtaaaaaaagaagagggagtgccacaatcagaatctttttagattaagtgtacttttttcgattctgcccggaagcaattgcggacaaatctgtcccgctttataatggagttaacattttaaaagagtaaagagataacgaaaacaggagccataccgcttatgcttaaaatacttttggttgacgatgaaaaatttgcgatagaaggtctcatttccatgctggactgggacagcttccagggagaactcatcggaactgcgtcctcgggagaggaggcggtgacactcatggaaaccatcacgccggacgtggttatttccgatataaagatgggaggtatgaacggcattgaactggcccgtatcgtccatgacaaaaatgaaaatatccggatgatcctgctcacggcccacggggaatttgaatttgccagacaggccatccagtacggagtcattgattacattctgaaacccattacccgggaaaagataaggctgctgaatgagctcctggtgcgcaagcaggaacagcttatgctgaggcgcaaatcatatctgaccgtatgggatgccgccctgaaggaacggctgctgcaggctttgaaaaccggagacaggaatacgctggatgaatttttccagtcctctctttttgaggaactgatgaacggcagcgactgtaatccggtgggaatccagctcatcaattacctctatgcctatctgcaggatatgaatctggatcagcaggcaatttcctattctaagaatgaaaccatggaaaattttctggatatgaccagcagacaggaaaaaatggattatatcatcacgaaattttacgatcttctgacaagcgtttcccagcagaaaagcgcccataccgatgccatcgcggcctttgccttccgctatatcggagagcattactgcgaaccggattttaacctgtccggcctttcctatgcgatgcatgtgtccctgtctcatctgagcaccgttttcaaacagacgacaggcaacaacctgagcgcttatgtgaccgagctgcgcctggagaaggcaagggagcttctttcggatatgcagtattccatatctgaggtttccgtcctatccggctacagcgacgccaaatattttgcaaagctatttaaaaagaaaatgggaagcactcccagtgaatacagaaacctgattatacagggaggtatcgatgggaattagaaaaaaaatcttctatatcactgcggcggccatgctgtccatcctgcttgtttcctacggcattatgtatctgtttttttatcatgtcatgtttgaggaaaccgtggtcagacagcgggccagtgtggaactgaaccgtcagatggcggataattttgtacagtcggtttaccatacggcggttcagcttgtcagtgataaagcgttgggcggatatttgagcaatccctgtaccgatcccatggaaaccatacagatgcgggaagccattaagacccagtttgcccattatgccacccatcaggttatagacagcacctattattacaggagcaccctttttctgtcggatatgcttcctatagcggattcctttgaagcatatacgctggacagcaatccttatgccgcgtccaataccgtttttaacaataccggtgtgaaggatgaggaatggtaccgggagacgacggcgcgtacggcatatgtattcacaaacgaagcgacagacgaattctgtattgcccggaaaatcatcaacaactattatatcgggccttataattcaaacggcacggcggtaatggtggtgagcgtggccagggatcagctggaaaatgtgttctccagtattcccgttacggagggaagcggctatgccgtcctgaatgaggatggggtgattctctattgcagcgattccggaatcccccgggaaatctatgaaagcgcccggacggattccggggatgaaatacagggggaactcaccctttccctgggaggggaaaaatatcttgtcagcaactgcgaggcccgatacgggatacgtcttctgtttctcacgccgaacagcgatattgtggacagcgtgcgtccgctgctgttcacctacagccttattttcgcaggaatagccctggccattctggttgtcatctatatactgaccggacggctgagcaggcctatcatccgtctctccggcgcaatcggagaggttaaggacaccaggaactatgataagaagaagctgcacgtgtccagcgagaaggaactggttatcctggaaaaaagcttcggccagcttatagacaatgtcaacgggctgatcgaggatattcggatccaggatgaaaaggaaaagcgttcccagctgcgggccctgcaggctcaaatcaaccctcatttcattttcaatgccatggatatggtgaactggctggccctttccagaaactgtgatgatattgcaagtatcgtctcatccatcgccaatatgatgcgctacagcatcaccaatgcggacggcatggtgccgattgatcaggaaatcgccaatatccgggagtttatttccgtttaccagctgcgtcatgataaccggctccgtctggagacggacattgatgcagaggatatctgtattcccaagttcactctgcagccgctggcggagaattccgtgaggcatgcccgtccgcttcccggggaggatctttgtatacgtatccgcgcctggaaagaagaggggaaggcactgattgaggttcatgataatggaagggaatgtgacgcacaggagctgaaccgccatatccgttatgaaaagacctcccttcaggtttccggcgggttcggcatccgtaatgtcaacgagcggattggtctttggtataacggagggagcggacttgtataccataatgaaaaggacggaacactgacggtccgtattattcttgatatcgcacagaaaaaaacagagcccgacaatctggggctgcccgtgacagcgggcggaaaggcagaagaatgaagaaagaattagtaaaaaacggagtgcatacgtatacggcagcagatcaatatgtgcctccggaggaaaaagaggtacgtgagcatgtggactggtttatgggccttaagctgggctttatgatgcactgggcgcccggctgccagctgggcacgctggaatcctggcccctctctgacggcgacgcctcctggtcccgcgccgatgtggactggacggatgaggaaaccttcaaggaacagtacaggaatgccaataagaccttcaaccctgtaaagttccgtccggataaatgggcacagctcgcagaggaatgcggctttaaatatctgctgttcacgacaaagcaccatgatggcttctgtatgtttgatacgcagacgacggactataaaatcacggatccttcctgtccctttcataccagcctctatgcggatattacaaggagcctgtatgatgaattccggaaacggggcatggccatttccgtttatttttccaagcctgactggcacagcgacgcatactggcaccatgctttcggcccggcgcccacaaggaacgtgaattattccataaaagaggaaccgcagctctgggacaggtttgtggactatacccaccgccagctggaggaactgggaacccggtatgggaaaatagactgtctgtggctggacggcggatgggtgaataaggataatctggatcaggatatccgtctgggagaaattgtggaaaaactccggaaagggcctcagcctcatcttattgtctgtgatcggactgtcggcggtatttatgaaaacattgtaaccccggaaaagcaggtgcctgaagaaccgctttttatcccatgggaaacctgtaccactgtcggcgaaaagttttccttccattatacggatacgttcaagtcaggcagggaactggtgcacctgctcctggatgtggtatccaaaggcggcaatctggcattaaaccttgcgccccagccggacggcgagcttcccggacgggcagtggcctctctgagagacatgggcagatggctccggatgcatggagagggcatctatgaaaccgttattgcagaacccttttttgaaagaaatattaaatatacaaaaaaaggaaagaccatatatgccttttatttatatgaagattatgccagtcttccgctccgcgttcatcttacggtaccggataaaatcagcagggtacggctgatgcgtaccggacaggatatcccttttgaacagatagaaaataaaattatcctggatacggaaacagcagtcagaaacaccgcattttatgcggactgttttatcctggaataaagctgtatcaaactcccaacataaatgcatccttcgaagcacatactaaatgtgtcggaggatgtatttttttgctgaaaaaattaaaaaagaactctaacaatatcattttatgcaacagaaaggagttttactatggataaaaacggtaatagtcttgccatagccagtgtcccctgtcagaagtggaaatccacctatgatccccagaccgcattaaaaaagggaacggtatttccggaattaaatatgccttttttcaaggcggatgactcggatgagataccgtccggaaagggaagcgcagatggaaagaacccggagcaggaggagagagaagcgcttatggccaaaatcgacgaagccggctttgtggtaaatgatcttacactgtatctggacacccataaagaggatgaagaagcgctccgtatgtttgaggaatatgcgaaccgaaaggttatgctgatgaaggaatttgctgagaaattctatcctttgtcccagaactgtatggttctgtgcggaaaagaaatgaaaacattcagctggacagatggtccggcgccttgggaaggagcgtgtatctaaatgtgggtatatgaaaaaagactgcagtttccggtaaaaattacaaaaacctgtccgaagacggcacagatgattatcagccagtacggaggcccggatggtgagctttccgcatccatgcggtatctggcccagcgttattccatgcctgtgaaggaagtgggaggactgctgacagatataggaacagaggagctggcccatatggaaattatctgtgccatggtttaccagctgacaaagcatctgacaatagagcaggctaaggaagccggttttgacgcgtattatattgaccataccacagcgctgtggccccaggccgcggcaggcctgccctttacggcgattgaattccagtccaagggagacgccatcgccgatttgacagaggatttggcagccgagcagaaggcaaggacagtttatgataacctgcttcgtatgattacggagcctgaagtaagggagccgcttaagttcctgcgtaccagggaaattgtccatttccagagattcggagaagcgctggaaaagacgaaggataagctggattccaacaatttttattatttcaacccggaatttgacaaggaaatgaaagacaaggataagttcaccatgtaagcaacagctatgagataagacggtaagggcagccattcattggatgtctttgccgttttttcttgcttgaaacgcttacctcctcatgatataattgcggagataaattgcgtgaatcttttctcaaaattatctgacagaaggatctgtatctttcattcatgtcatttgacagcaggatcaggaaagggggatatcttatggtaccaagtctcgcaaggatgtctgttataatcaagtctcagcatgaaacctccgttatgacgggaaattatgaaatggcctatatatgcggcctgctgtgcaggctgacaggaaccgtgccgccttctctggagacacccgttcagcttcaggaagatatgatgaagcttctggagaattacagcccggaagatgacagagaaaaagttgtgattaaaatgcttaagttttataagcccgacggcctgctggatgatcaggtcagggagctgtaccggatgggactggaagagaaaactccatggaaaagataaaataacaggagattaacatgccgaagaagaaaatattgctgctcaccacaggggggaccattgcctcccataaaacagaatacgggcttgccccggcgcttaccgcggaagaaatcctggatttccttccctccatgagcagtatctgtcatctggaggccaggaatctcttcagtatcgacagcaccaatatgaccagcgcccactggatgcagatcgccggagccattgaggagagcttttccggctatgacggctttgtcatccttcatggaacggatactatggcctatacagcggcagccctgtcttacctgattcagaattcccccaagcccattgtgctcacaggctcccagcgccctctggaaatggaaatatcggatgcccgcatgaatttgcgcgacagcattgtctatgcgctggatgaagcttccgtcggcgtcagcgtggtattcgggggaaaggtgatagcgggaaccagggcaaaaaaggtgaagaccatgagctacaatgcctttgccagcatcaattatccggagctggcggtcatgcgtgatgagcatctggtccgttatatcgaacagaagcccttctgtgaaccgctcgctttttaccatgagctgaattcccgcgtcttccttctgaagcttacgccgggaatgtctccgcttattttgaaggatatcttcagccagtatgacgggattattgtggaaagctttggtgtaggcgggatccccgacagccttatccatgaattcgtccggctgatgaaagaatatgggaccggaaaagccgttgtgatgacaacacaggtaacctatgaaggcagcaatatcggcgtttatgaggtgggcaagagagtgcaggagcagtttcctttgctggaggcctatgatatgaacctggaagccgtatttaccaaactgatgtggattctcggacagaagcccgcaggtttcgaagaggtcaggaacctgttttacaaaacaatcaattatgatttttttatgtgaatattttccaaatgtccttcatatactttttaataagaataaggtataacaggaggacaaccatgccaagaggaagaaaaaacaaatctctggacgaaaaaatccaggatacacagcagagcatctacaacctggaggtcaggacacaggagctttatgaggaattggaagagcttttgaagcaaaagaaaaatgaagagcttgaaaaattgtcggaagctctcgaagaagccggggtttctgtggatgaagtcttagcgcagctgaaatcagatgaccaggaaaatatcgcctgaattgagtgaaagagaataagaagagaaagagcaggagcggccccatgcgacagcagcatgaggatggttcctgtttttttataaaaatttaagaatttgaatccgtgaaaaggaaagaaagaattgcatgaaagctttttaaaccatataatagaaataacgcactaagaaaggagggacgaaaatgagtgtatttgggaatattatatggtttatatgcggcggtttcttcagcgcactgagctggctgctggccggtattttgtggagtataacgattatagggctgcctgttggaaaacagtgttttaaatttgctgctttggccgcctgcccttttggaaaggaaattgtttacggcggaggcgccggttcgctgattctgaatattttctggatgattttgacgggaatccctatggctctggaatctttagtgatgggagtcctgctttgtataaccattattggtataccatttggtctgcagcattttaaaatggctaagcttgctttgatgccttttggctcgcagataatatatacgtaaggaacgagggagtgttgatggaacaacaaatgaatgaaacaggaatgaaaaagaaatttaatctggcggcgctgtttgctccgacggatatgacggagggatcgccgggaaaacggattgttgcatttgcaatacctatgctgataggcaatattgcccagcagctgtataacacggtggatagcattgttgtggggcgttatgtgggagataatgcgctggcggccgtaggaagcgcgagtccgattctgaatctgctgctggtattgttcgtgggtatttccgtaggggcgagtatcatggtttcccagtatttcggggcaaagcagagagaggagctgtccggctccatcggatgcagcattacgctgacagccatttcttccgtaattatcatgatactggcgccgctggtggtcaggccgctgctgaggctcctgaatacgccggacagcattatggactggtgtgcctcctatctgataatcctctttgtgggaatcgcaggtatgtcttattataatattctcagcggcatcctccgcggtctgggagattccgtttctgctctggtttatcttcttgttgccaccgtactgaacattatactggatattctgtttgtggccgttttcgatatgggagtggcgggcgtggccctggcaacagccatcgcgcaggcggtgtcggctgttatgtgtatttttaagctggcaaggatgaaggatatttttgatctgaagctgcattatctgaagccggaaaagaagcattcggcggacatgatacgtcttgggcttccttccggattcacacaggctattttttccatggctatgataatcgtacagtccctgaccaacagcttcggggaaatgttcatcgctgcgaatgttattatcatgcgtgtggatggctttgccatgatgccgaacttttccttcggcacggcaatgactacatatgccggacagaatgtgggagccagaaaatatgacagggtggaaaagggagccagggaaggaaccatcattgcggctgtcatatccgccgttattacctcattgattcttattttcggtaaatatctgatgggtatttttacggaaacaaaagaactggtggaattgagcatgcacctcatgcagatactggccgtaggatatatcgccatggccgtaacccagtgtctgtcaggcgttatgagaggcgcgggagacaccatgacacccatgtggatatccctgataacaacagtagcgattcgtgtccctctcgcatacgggatcgcctggatgacaagaacgccggagcttcccaacggaaggaatgaatgtgtattcatttccctgctgtgttcctgggtgctgggcgctgtaatgacctatttcttttacagaaagggcgcctggaagaagaaagcgctggaaagctagaagcattataggtattggaatacaaaaaatgctgctcatttatcctgagcagcatttttgcatgacattaagccttattttggctgagaggattaatcatcctctgcttccgtgtttttaggtttgggagccatataagtggaattccctacataatccgtactcacttccttgccgtcctgataagtggtgaagtatgttttagcggaaaggcttcctgtattctttgcccagagcttgaagctgcgtccgtttaaatcatgatcccataccaggacattgatgatgagttttttcccttccgtgtatgcctgcagtataacaggagcggaatagttgttgcggaaccgtaagtccttggagccggaagagatggctgcgtccagacccagcggcagataatgtacgggcatgctgtggggatggcgttccagaaccaccagaccggcattcttcactgcgttataggtcgtggaggatacctgacagataccgcctccgatggccatgactgtttccccgttcagataagcgcccgcttcccggtagccgttggcagaggtccggggaaggatggcagtgctgacggaaacttcctggcctggcatgatgatcatgttattcagatgttccgccgccaccttgatgttggtaatccggttggaggagcttccggaaaagctggtggtacagcttcctgccagcacgaaatccgggctgtaggtcagaactccctcatttacaacagaggtgagataaccggaggaaagctctaaagtaagaggctgggggcttcctgcggcaaactgctgctgaagcgaggttatcagccagttttttacattggcattaagctgataataggtttgtccggaattatagatgtagcttcccgttccggtatcaaatacagggctgtcactctggaatatctgtgtcttgagctgctcgttaatcgcgttgagaaatacatcgataacctctgtttctcccagtatgcactgagggatcccggtatcgttggagaggaagaccggatagtccttcatggtattgatgcccatggcccagacctggccgtccaaagtcaggataatgttctggttcatccatcctgcgtcgatataacggctgtctgaaattgtagttgtaatgcctcccgccggaagtgcctcggcagctgaaaccggaatgggcatggctgcagcagcggataccggtgcggcaagaagcaaacatatcagtagtagtggtttccattgatgtcttttcataactgaataccgtcctttcgcaaatacaccaattctctgggaattgatctttaatagaatatcatacatgaatcaaatttccaataaaaaaaacactttttataaaaatatggaaatgaaacggacaaacggttatgatagagaaggaaaaccaaatgctgacggaggcctatatgtataaaattctgattgttgaagatgacagtaccataacggcggttttgaagcgtaccctggaaaaatgggggtatgaggcagagacaatttcagatttcggccgggtgggggaagaattcatccgctgttctccggatttggtgctgctcgatatctcactgcccttttttgacggctattactggtgtcaggaattcaggaagacaagccaggtcccgattatttttatttcctcggcttcagatgatatgaatctggtgatggcggtaaatatgggagcggatgatttcctttcaaaacccttcaagctggaagtggtgctcgccaaaatacaggctctgctgcgcaggacctatacctttggaacccgcagggatgtgctccgggcgggagacgtgatcctttcccttaacgatgcggtgctgagctatcatgactgcaggctggaactgactaagaatgagttccgtatactaagcatattgatggaaaagcgggggacggttgtttcgagagatgagatgatacggaatttgtgggagaatgaatcctttattgatgacaataccctgacggtgaatatgaccaggctgaggaagaagctggaagaaataggactgaaggattttatagaaacaaaaaaagggctcggttatcttctttcagataagccggaatgagagcgggttatgaagaatagaaaaaagtatggattggattatttacgggagcagaaggggtacctgctgtatctgctcatctatgtctttcttttgttcgtctggtggctgtgtgatctgccgtggcagcccatggcctatttatttctgctgctgacggtttttgcgtccattcagcttctgtatggcctgcggggatatatccgcaggagagagcttcttgaaatgtatacgaggcaggccgcagagggtgtctttgcggcggaagaggaaaaagagggccttgagggagactggtatggactggttaaggcctggcatgaggaatatgagcggcagaaagagcaaaaccaggaagaaaaagaacagagcggtaaatattataccctttggtcccatcagatcaaaacgcccatcgccgctatgaatctgcttctccaggaggaagagccggatctgaaatccctgaagcaggagttatggaaggcagagcagtatgtggacatggcgctgcagtatcagcgcctggatcgaagcgggagggacttggtcttaaaagaatatcctctggaaacgcttgtaaaaaaagcggtaaaaaatatggcatctgtttttatttacaataagacagggcttcagatagaagctatgcccgggaatgtactgacagacgaaaaatggttcctgttcgtactggagcaggtgctcagcaatgcggtgaaatatacggcgggcagggaaaacggaaaaatccggatatattccggccgcacggataagggagaaaccgttattgtggaggataacggaatcgggatccgaagggaagatattcccagggtgtttgaatggggctataccggttataacggaaggcgggaaaagagatctacgggaataggactgttcttatgccggcaggtcatggatatgctgggacagtccattgagatagagtcggaggaaggaaaaggaaccagggttatcctgggggtatccaggaaaaaatttgatatggaataattggaagggattcattcaaaaaaataattgacattccggccacctgtgcatataatataacacaatactctttgcactgcatacaaatctacagtacaaactgagcaggctgtgttttctgccggcgtatgtatttcaagccggaaaggatccatggatagccgggccgttttgacggcagcagatggagcttacatctgtgggacagtatttttacgctgttccacaggtgtttttttataccctgaggaacatgtaaacgaaaatattgtatgggtcatggagttatcttaccaataaggaggtaacttttatgaaacaaatgatcagaggaaacaaggatatcagcgaagaaaccagaattgccatgagggtatccgtgatcagcatcgtcatcaacctgcttttgtcgctgctgaaactggcggcggggcttattgccaaatcagaagccatggtatcggacgcggttcattccgcttccgatgtgttcagcacctttattgtcatgattggggtggctgtttccgggaaaaaatcggattccgggcatccgtatgggcatgaacgcatggagtgcgtggcctccattgttctggcaattattcttgcggcgacaggaatcggaatcggcgcgtcgggaatcgggaaaataatgtcgggagatcccgcagcgcttcaggtaccgggaaagctggcgctggcagccgctgttttatccatacttgtgaaagagtggatgtactggtatacaagggctgccgctaaaaaaatcaattccggcgctctcatggcggatgcatggcaccatcgttccgacgcgctgtcctctataggagcctttgcaggcattctgggcgccaggcttggatttcccgtacttgatccgatagccggtctgctcatctgcctgtgtattgaaaaagccgctctggatatcttccgggatgcggcagcgaaaatggttgacaaggcctgtcccgatgagacagaggataaaatgaaaaaagtaattctcgcacagaatggcgtgcagcgggtcgatatgctgaaaaccaggctgtttggctcaaaaatctatgtggacgtggagatttccatggacggttccaagcctctggtggaaacacaccagaccgcagaggaggtacacagcgccattgagagggaattcccggaggttaagcactgtatggtccataccaatcccatgtaaacagtctgcataccttacacaaatgtaaggttgggcatgaaaatgtaagccggatcgatggcatcttttttcctgctttcttataatgaaaagcgtaacagccaataaagataaggcagaatggaggataaagatggcactgttagaagtaaaacatctgaaaaaaacatatacgacccggttcggcgggacaaaggtggaagcccttaaggacgtggaattttctgtggaaaagggcgaatacgtggcgattatgggggaatccggttccggaaaaacaacactgctgaatattctggcggcgctggacagacccaccggcggtaaggtgctgcttgacggaaaggatatggctgcggtgcccgacagccggatggcggcttaccgcagggataaccttggtttcgttttccaggattttaaccttctggatactttttccctgaaggacaatatatatctgcccatggtcctggcaagaaagaattataaggaaatggaggaacggctgaacccgctggcccggaagctggaaatcgatgaactgctggaaaaatatccgtatgaagtatccggcgggcaaaagcagagggcggccgttgccagggcgttgatcaccaatcccagaatccttcttgcggatgagcccacaggtgcgctggattcccgcgcggcggacggactgctgcggatatttgaagagatcaacctgagcggtcagactgttttcatggtaacccacagtatccgcgcggcgagccatgcaggacgcgtgctcttcattaaggacggaattatattccaccagctttacagaggcgattgctccaacgaggaaatgtaccagaaaatatcggatacccttaccgtccttgctacgggcagagaggaggcgtgatatgaataccatgcataatcttctgttttacccgcggctggcaaggaccaatatgaaaaagaacagcagcatttattttccctatttatttgcctgcagcctgatggcagggctcctttatgtccttaattccgtgtcggtcatggttgtcgacagcggtatgaagggcggggatatcatgtacatgctggtccggatttgcttttttatatgtatcttttttgtgtttattatcctgttttatataaacagctttattatgaagcgcaggaagagggaattcggtctgttctgtattcttgggatggaaaaaaagcatctggcgtttgtccttttctgggaggtcttccggagcatgctcgtaagtattctggccggaattgcaggagggatattgttcagccagctcatgttccttcttttgctgaaatttgtgggactgccgggtaagcttgttttccggatccccttccggtccgtaggagagaccattctcatttatctgatctgctttttctttgtactgatatacgatattatcagcgtatcgagagcgaaccccacagaacttttaagaagcagcaaggaaggggaacgggaaccgaaaaccagatggctggctgctgctgcgggagcggcggcgttaggagccggctatgtgaaggcgctgaccacctatacggcttccgacgctcttctggcctttttcccggcggtggttctcgtgattatcggcacctactgtctgtttcaggcggggagcatcgctttgctgaaagcgctccgcaaaaacaaggccttttattataaacctgagaattttgtttccgtttcggggatgatttaccggatgaagcagaatgctgcgggacttgccagcatctgtatcctgtccacagccgtcctggtaacgctttccagctgtctcagcctgtatgcaggggaagaagatatgctcagaaaccagttcccgagggaaatcaacatatattcccagataccggagcttacggaaaatgcagacagccggacggaagaacagggaacggtgacttccggtctgcctacagccgtgcatgaagccattgataccctttcggcatccaccggctgcgaaacagaaaacagcatggaattttatcagctgtcgctcgccgcgtcatatgaaaataacagctttaccacagctctcggcaataagggaagctcaagcatgctttatgttatggaactggccgactataaccgtctctacgggaaaagctatgagctgggggcaggagaagcgctgttctttaccaccgggacgccagtcgaaggggaagcggatatctgcggggaaaaataccggatacgggagcagattgaaaaatttgatataacgcagcttctggggtttgcaacgccggtagatctgagcgtattcgtcgttcccgggttagaggatatggtaaggctggccaaagcaggaaatgccctgattccggataaaagattcccgtcttatatctattatcatacattctttgacatcgacggcagcaaagaggctgttgctgcgtttgaagaccgggcagcaggggaaatccccggaatcacccgtatttatgtgagaaaccaggtaagggcggaattttatgagctctatggaagtattcttttcgtggggattttcttcataattctgttcctgacggcaacggtcctgatcatttattataagcagataacggaaggctacgatgacagagagcggtttggtatcatggaaaaagtggggatgagcgcaaaggaagtaaaaaggaccataaccagacaggtactcatggtttttttcctcccgcttggaatggcggttattcatattgcggtggcctttccccagctgtgtaagatgatgacggttttcagcatgaccaatgcagggctgtttgccgtatttaccatactttccgtattgctattcggcctggcctatctgctggtataccgtctgacagccagaacctattttaaaatcgtacagagctgatttacggaggacaccaatggccggacaacaggaatgaagaaatcctgttgtccggccattgttctgtaaaataagttaaataattccaatcagctgtattttataaaaatatattgccttttccatatggctgtgttagtataactaacgcaggttagtttgaacaaaccaaagataactaagcagctgggtctattcagcaaaagaaagggtgtattttatgataaagcggaataaaaaggtattattggcctgtgcggcattgacactggcaggcctgttgggagcttgttcctcctcttcgggcccggcatcggaaaattcttctgtgaaagaatcccggacgggcagcatttctgaggaaacagtacagggaaacccggaaatgacggaaacggaaacaacagcggcagaaggaatgcgtacggtagagacggacaaaggccctgtggaaatcccggtaaaccctcaggttattgtttctgattattacctgggagaatttctggcagtggatgtaaaaccggttattgcatcgccctattctctgtcaaatccgtttctggaagggaagacagacggaattgaggaattaaatacggttagtgcggagacttctttggaaatgatcgttgcacaggaaccggatctgattgtaacgattacggaagccgattatgagaaatatgccgaaatagcccctaccgtgtatattcaggacggaaagcgcagcgatgaggatctattccgttatattgcagatctggtgggcaaaggtgatgaggcggaagtctatataacagattttaataaaagagtgatggatgtaaaagaagagatacagggaattgtaggagaacgtacggtatccatagtggaagtatggccgcagcagatttatacaatgggcagccattttgccagaggcggttccatcctgtacgatatgtgggaactgaaggcaccggaaaaggtacagacggaaatggttgacgcagatacctcctatgaagtggtgtcgctggaggctttgccggaatacacaggggattttattctttatggcatattggcggataccgacagttccttcgtggatgattccgctctgtggaacagtcttgacgcggtaaaggaaggccgcgtactgccttatgaacaggtggcattcatgcacagggatcccattactctcaatgcacagctggatatttttgttgaatttttccgtggctttgagggaaaagaatgaatgcgggcaggcataaaagaatgatattgttcctgctggcaggaagtgctgcggttatattggccgcggcattttctgtgttgtatggaagcacaggaattcctgcaaatcaggtcttcggcgctattgtgcaccccgatatggaaaacaggcagcatattatcatacgggaacttcgcatcccgcgtacgcttggatgtatgctggtgggcgccgctttttcttcagcgggcgccatcatgcagggagtgacccggaatccgctggcagattccggccttttggggatcaatgccggcgcgtcctttgccctggcgctttgtcttgcttttctgccgggctttggatttacaggagtggtatgcttttcctttctgggtgctgcggccgccatggtgaccgtatatggactgatgagtctgaaacggcggaagacagatccggtcaggttggtactggcaggcagtgccgtgagtatcttcctttcttcgctcagtcaggcagtatctattttctatcatatcggttatgatctgacgttttggacggccggaggggttgcggggatccgccttcatcagctgctcctcgccgggccggtaattctggccgggcttctggctgcggcagtgctttccggacgggtatccatgctcagtctgggagaagatgctgccagaggactgggactgcatgtggaacgttcccgtgcgctctgccttctggtggtgctcatgcttgccggagcggctgtggcgcttgccggacctgtggcctttgttggattgatggtgcctcatgttgtccgtttttttgtcggcggggattaccgcagaatcattccttgtacgatggtggcaggggcctttttcatgcttgcggcagatattctgtcccgggtggtgaatgccccctcagagacaccgatcggacttgtatttgctgtgattggtgtgccgttctttatctggacggcatgaaaggaggagagagcttttgactgaatccggacgaaaactgcggacaagtgcggtcatagccatattggcggcattgcttgccgcaggaatatggatggatataaatgcaggctatcgtaagataagcccggaggagctttggcagataatcctgggcggaggggagaaaagcctgcggtatacgcttcttaacctgcgtctccccagagtccttaccagtctgctggtggggacagggcttgcggtttcaggatgtgtcattcagggggtatcccgtaatgaaatggcagaaccgggaatactgggagtgaatgcgggagccggactgtttatagcggctttcatggtatttttaccgcagagcggtttgaagcttaccctgcttttgcctgtgctggcgtttgccggttccctggcagcggcagccctggattacaggctggccctgacaagacagggcctgtctcccaaacggcttctgctgatcggaatagctatgtccaccataatttcaagcctgaccaccatgctgatgctgcgtatgtcagacagtgaatatgcctttgtgcagaactggctggccggaagtatatggggagcttcctggcccaatgtacgtctgctttcccttggcctgacggcgctgatcctgtttgtattttataagagcaggacattgaatgtgctggctttgggacaccagacagccaccggcctgggcgtggatgtttcccggcagtcggcgatccttttaggggcggctattgccatgtccagcctttgctgtgcggtgggaggagggctgagctttgtggggcttgtgtgccctcatctggcgagaaggctggcagggcctgattaccgcgtcctgcttccggcaacggtgctttccggagcggtgctgatgaccttttccgatatcctgtcccgcacacttttagcgcccaatgaaattcctgtgggcattgtggcggcggtgatcggagcgccttattttctatatctgctgatcaaaacataaaggaggagagcaggatggatgctgtacttacagggaaaggcatttctgtggcctaccagcaaaatattatcattccgtctatgaatgtggaaatcccccggggctgtgtgacgtctgtcatagggcctaacggatgcggaaaatcaactctgctgaaagcactgtcccgcatgctgccggttcgttccgggcaggtgctcctggacggcggcatgatagcccggatgcctgccgcagaggtggcgaagcagatggcgattctgcctcaggggccgcaggccccgggaggactgacggtagccgaactggtggcatatggaagatatccgcaccaaaaaggcttcggaagactccggaaggaggattataaggctattgaccgggcactggagatgacacatatggaggaattcgccgaaagagatatcgatgcactgtccggcggacagcggcagcgtgcctggatcgccatggcgctggctcaggatacgcaggtcatactgctggacgagcccacaacctatctggatatggcccaccagctggaagtgctgaagcttttggaaaaactgaataaaacccggggaaagaccattgccctggtgatccatgacctgaatctggccgccaggttttctgatcggatgattgccatgcgggaaggaaaggtgctgcatgagggcacgccggaggaaattatgacaccgacggtgctggaagaggttttttccctgaaagcctgcatcagcaaggatccctggacaggcaggcccacatgcgtcacctatgagatatcctgaatgataaaattaataaaacagaaacaattctgaaacaaaacgcaggtattacagtgtataatgaagctgtaacaatgccggcggatgagtggaggatacagacctgtgatgcgaagaatcatcaaatcagcgatacacaaaaacagactggctggccttttgtatgacaattactcattgcggacggttgttttcgcttatggcgcactgggagtcaatgcatatcttgcccttacaaaaggggctgccggatggtattttggttccgattggctgagcacgctcgccatgtattacttgctgctgtgtgtgattcgttttacactgctgcgggcgagcaggaaggtaactgctctgaccgatcaggatgcccgcatgaggaaggaatggaaagcctgccgtgtatgcggtgaagtgtttatgggaatgaccgttattttgatggggatagtggtgctgattacagccgaaggattcacctttgcatatgatggactgctgatttatgctgtcgcagcatatgattttttctgcctgacaaaagcgatcatatatatggggaagaaccgcaaaaaccatacgccgctcatcgtcgccataaaatcggtcaatttagctgcagcgcttgtttccatcctttcccttcagacggcgatgtttgcggcctttgggtctgatatggaaactgtggtgcagactcgtatgaatctcgctaccggcgccgctgtgtgcatgatgatttttttatttggtttctttatggccgtccattccaaaaagcagatgaaagctttaataacagggaaaaccaacagggaggcgtatcaataatcaatattctggtattagaggatgatgtaaaattaaatcagatagtatgtacttacctcaatgacagcgggtttcatgcaaagggctgcctgaatgccaatgcagcatatgatgaaatgtataacaatctttatgagctgattatttccgacatcatgatgccggggacagacgggtttgaatttgctgaaaatgtgcgccgggtcaataagcatattcctattttatttatgtcggcaagagatgatctttcctctaagcaaaagggatttcggctgggaattgacgattacatggtgaaacccattgagttggatgagcttctgctgcgggtgagggctttgcttcgccgcgccaatattgaaatggagcgtaaattggtcattgggaatctggagcttgacgctgatgccatgagcgccgttgcaggcggagaagatatcccgattactacaagggaatttaatatattgtataagctgctgtcctatcctaacaaaaccttttcccgcgcccagctgatggatgaattctggggaattgagtcggaaacaagcttgagggcggtggatgtctatgtgacaaagctgagagataagttctccggctgcgatggtttcgagatcaaaacggtgcgcgggcttggatacaaggcggtgcttatatgagtgaaaatacaaaggaacggcggaaaaaaggaaagaaaactcgttttcccgtgtcacttttctttattcattttggatttcttctgcttatgtcaggtcttcacagcggattaattgttctgatgggaacacttaaatggaatgatacagtacaatccattgtacctatcgtctactgggcatcggtcgcctttggccttacaatgtatacacggtaccggatgaagcagacctatgatgaaccgatgcagatgctggccgaggctaccgccagagtggccgccggtgacttttcaatttatttgccggctatacatacggcagaccggtacgattaccttgacaccatgtttttaaactttaataaaatggtcgcagagcttggaagcattgagacactgaaaaccgattttttttccaatgtttcccatgaaatcaaaacacccattgcggtcattcaaaattcagcccagctcttacagaaggggaatttgtctgaggaagagcagcgacgctgtatggatactatcgttcacaccacccataaactttctgatctgattaccaatctgctgaagctgaataaactggaaaaacagacaattcaggcggtgccggaagaatatgatctttgtgagcagctttgtgaatgcgcgctgggatttgaagcacaatgggaaaagaaaaacatagaatttattgcggaaatggaagattccgccgtcattcgcgcggatgccagccttatggagcttgtgtggaataatcttatttccaatgcgctgaagttcacagaatcgggcggaacggtaattcttcgccagacttcagaaaaaaatcaggcaattgtggaaatttccgataccggctgcggtatgaacgatgaaacgctccggcatatgtttgataagttttatcagggggatacctcccattccacggaaggaaatgggctgggactggcccttgtcctgagaattttacaaattaacgactgtactgtagcggcagagagtaaatgggggaagggtacgaaatttacagttaccattccattaaggggagaactggaaaatgaatgaagcgaataacagagacagtgagttccttggctatgagtataaagagctttccgtggagcaaagccgtgtttccatgtacctggacggatataagaattttggatggatcgcggatgataattttgatttgcccaaagccggaagcatggccacgcttcatctgaaacgcaaccggaaaattatgaacaaaatggaactgaccaggctgcagcgcaactttgaagcatgtatgaatgagattgagactctggaacgctcaaaaacagccaatgcccgtattgcatcgcttacggcaggcgtcctgggaacggcttttatggcaggcgctacctttgctgccgtggcaagtccgccgattatctggctttgcatccttttagctgttcctgggttttcaggctggatcgcaccgtacttcttatataagaaactggtacagaagcggacggcgaaagtggttcctctgattgaggcaatatatgatgaaatttacgatctgtgcctaaagggctccgcacttctttaatagtaaaattattttattccgccggttttccggcggattttttttgacagcccaccatgaatgattcttgccgtgtgattaataattcgtaaacacaattcaagcaaaatacacataaaacgtttgtaatatagagtcatcaaagaaagcaagaccaattctgaagaagggaggatgtctgaatgacgagtaagattatcattgctgccgttgtcattgtcatcattgctgcagtagctgttattatcaaaaagaagtaagccaaataaaaaataataaaggataaagactatgaaaaagaaaaattttgtatctatgattatgagtaccatcggcgggattttgtttgccatcggaatgtgtatgtgtctgcttccccagtggaatgctttcacacagggcgttgtaatcggtattgttggtgctgttgtattactggccatgctgattgtccgccgcaggatggaaggaaagccggccattcggctgaacggtaaggcaatcggtacgatgcttctcggaattgccggagccctggcattcggcacaggcatgtgcatggttatggtttgggaattgctggttcccggtattttcgcaggccttgccggtatggtattgcttctgtgcctcatcccgatttgtaaggggattaagtaagcagaactgttttgacaggatatatgctgtatcaaaaagttatacaaacaccaggaggaaattgtaatggctaaatcgaaattaataaaagcaaacaaaaaaattgcagaaaccgtggtaaacggttataagggtattgagaatcgtgttgtgggcacttatacgaagattgaggataagttcgtcgatcaatacctgactcatgagggtgagtccgttgaggatgcgaagaagaggatagccagggaacaggcagcagccgatgaaaggcacaaagcagaggcggaagcccgtgctgccgggaagaagatgagagccgaagcaaagatataatttttaccgcaacaggttcttttggggcacaaaaaaggctgccagcttgatactgacagccttttttgtgccctgactgatgcctgcaggcacgtaatgcagtaactttattcaggatgctgctccttctgcaggtttttctgtgcggtggagagcatcagcttgatccggttcagctgattaacttcactggctccgggatcataatcaatggcgacaatattggatttgggataacgcttgcgcagctccttgattacccccttgccgaccacgtggttgggaaggcatccgaacggctgggtacatacgatattgctggtgcctgtcttaataagctccaccatttccccggtaaggaaccagccttcaccggtctgattgccgatggaaacaatgggagcggcataggaagcaatgtcgtcaatcctggccggtgcatggaaatgactggatttttcaaaggctttggcagccccggaacgcacccactgcatggctttgattccggccttggccgtaaatgcagattttttgctggttcccaaatgctccgccttatacagctggttatagaagcagtaaaacatgaaatcaagcaaatcaggaactacagcctcagccccttccgattccagaagatccaccagatgattattggcggcaggggcaaacttgacgagaatttcccctacgatgccgaccttgggctttatctcatcggtaatgggaatagcgtcaaagtcctctatgatctcccggcataaacggaagaatttggggaatccgggatgctttgacttcacgaaagctttacaggtttccacccatttacgatgacaggcattgacgcttccgggttctttttcatagggacgcatgcggtatacgcagcgcatgaaaatgtctccgaatactgcgccgtaaacaccgcgcagcagtacatccagattgagcttaaagcccggattgctttcaattcccgccatattgatggaaatgacgggaacctgctccattcctgccttggcaagggcacggcggatgaaacctacatagttggtggcacggcagccgcctccggtctgggacatgatgacggcgaccttatttaaatcgtacttacctgacaaaagagcttccataatctgtccgattacaagcagggaaggatagcaggcatcattgttgacatacttaagccccatgtcaatggcatgccggttatcattgggaaggacctccacacgatagccgcaggcgttgaaagccgcctccagaagttcaaaatgaatcggagacatctgcgggcacaaaagagtataatctttgcgcatctcttctgtaaagatgaccctgtgaagggcagtggaggtgatggtccgtttttcctttttcttttcctttgatttaatcgcggaaagcagggaacggatacggattctggcagcccccaggttatttacctcgtcaattttcagacaggtgtaaattttgcctgaaccggtgagtatatcgtttacctgatccgtggtaaccgcatccagcccgcagccaaaggagttcagctgaatcaggttcaggtcgtcccttgtgcggacaaaagaagcagcagaatacaatctggaatgatacatccactgatccgatacaatcaaaggccgttccggctgtcccagatgggatacggaatcttcggtaaggacagccaggccgtaggaggtgatcagttcaggaattccatgattgatttccggatccagatgatagggccttcctgcaaggacaataccctgtgtacccgtttcttccatataagaaaggacttcctcaccttttctcttaatatcttctctggaagcggtcatttccgcccagcccttttccgccgcccggagcacttcttcttcaggcagctcggaaaattctttgatcaattccttttcggcaacttccaaattagtgaaagccataaatggattgcgcaggactgcttcgccgcggccgatttcatccacattattcttgatgttttccgaataggaggtgacgatagggcagttgtaatgattgctggcatccggcgtctcatttctttcgtaaaagagagcgggatagaagatgaagtcaacaccctgcttaatcagccaggatacatgtccatgggccagcttggccggatagcattcggattcgctggggatggattcgattcccagctcatagatgctgtgcgtggagctgggggagagaaccacctgatatttcagttctgtaaaaaaggtataccagaacggataattctcatacatattcagcacgcggggaatccccacacgtcctctttccgctttatctgccgacagcggttcataggaaaacagccttttcagcttatattcaaacaggttgggaacctggcttggattcttaggctttcccagacctctttcacagcggttgccggagatatactggcgtccgccggaaaaacggtttatggtaagacggcagtgattggtacagcccttacattttgccatgctcgtttcaaactccagggaattgatctggtcgatgttcagcatggtggtctgataaccggcgctgtaattgtcacgggcgatcagggcggctccgaaagctcccatgataccggcgatatcgggacggacagcctcgcagtccgcaattttttcaaagcttctcagcacggcatcattataaaaagtgccgccctgaacaacgatccggttccccagctcagaggcatcagataccttgattaccttaaataatgcattctttatgaccgaataagcaaggcctgcggatatgtcggaaacctccgcgccttccttctgggcctgtttaaccttggaattcataaatacggtacagcgggttcccagatcaatgggatgtttcgcaaaaagcgccgccttggcaaaatcctgcacactgtaattcagtgacttggcaaaggtttcgataaaggatccgcagccggaggaacaggcttcgttcagctgtacgctgtctaccgtaccgtttttaattttaatacacttcatatcctggccgccgatgtccagaatacaatcaacctccggatcaaagaaggcggcggcatggtaatgggccacggtttccacctcgccgtcatccagcaggaatgcggctttcatcagagcctcgccataaccggtagagcaggaacggacgatcctggcgccgcggggaagttgggaataaatatcctgtatggccccgatcgcagtctttaacgggctgccgttattattgctgtagaaggaatacagcagggagccgtcttcacccaccagggctacctttgtcgtggtgcttcccgcatcgatccccagatagcagttaccgacatagtcatccagagatgcggttttcacgcaatggctgtcatgcctggtgcggaaggattcatattcttcatcggaagaaaagagcggatccatacgttccacttcaaattccatcttaatgccggaggccagcttctgtaccatttcctctaaagttacaaaaacctcttcctttgcatttaaggcggaaccgatagcggcgaacagatgggaattatccgcttcgatcgtatgctcctcgtccagcttcagcgtacgtacaaaagcggtctttaattcggaaaggaaatgaagcgggccgcccagaaaggcgacatgtccgcggattggcttaccgcaggcaagtccgcttatcgtctggttgaccacagcctgaaaaatggaagcggagagatcctctttggtggctccttcattaataaggggctgaatgtcggatttggcaaatacaccgcatctggcggctatggtgtacagggatttgtagtttttggcatactcattaagccctgccgcatcagtctgaagcagagaggccatctgatcaataaaagaaccggtaccgcctgcgcagataccgttcattcgctgctccacattcccgttttcgaagtaaatgattttggcatcctcgccgcccagctcgatggcaacatccgtctgcggggccagatcctgaagggcggtggatacagcgataacttcctggacaaaaggcacgccaagatggttggccagcgtaagcccgccggatccggtaatcatgggatgaagggtaatatttcctaattgggaaagactgtcttttaacagctcggacagggtctcctgaatgttggcaaaatgtcttttataatcggaaaaaagtatatgatgggcctcattcaggatagcaattttgactgttgtggaaccgatgtcaattcccagagtataattcattgcattattcatatggtaaaaacgccctttctacttattaaaatgtatctttgaacaactttttacattatacgacagcagtcgcgcaaaagcaaccaaagatgatgttaaaaaaaatttggcaatttctaaactttttataacatttatgaattccggcatacttccgtttactttttccaagctaaatgatagaatatattcgcttaggctgcttaccattctgaggcagggaaagcaatatttaagagcacagactcattaatgaaaccgcgtgaaccgcagataggagtattagtatgggaagcagtttttccacgaaattcgaaagaaaattcggtaaatatgccataccgaatatctcattgtatttgattatatgctatgcggtaggatatttgctctcgttgatctatcctgcctttttgggatatctgaccctggatccctttgaaatttttcttcatggacaggtttggaggctctttacatggattctgataccgccaagttcctccaatttgttttttacattgataatgctggtgttttattactccatcggaacacagctggagcggacatggggaacataccggtataatctttacctgtttttaggtatgatttttacaattgccggaagtatcattctgttcctttactgcctgcttataggcgcgcagccgttagcgttgggaacggagactatctattccctgagcaacggaatccatgtatattttggctccttcagtacctactacatcaatatgtccatattcctggcatatgcggcaacctttccggaaatgcaggttctgcttatgtttatcatccctatcaaggtgaaatggctggggatcgtttacggagccatgctggtgtttgaatgcctcaccggaggaatggtaacctggtttgttatcggttcttccttactcaattttgttgtattcttcctgaccagcagaaaccatatccacatgtcgccgaagcagatgaaacggagacacgatttcaaaaagcagacccatgccccctccgggatcaccaaacataaatgtgcgatctgcggcaggaccgaaaaggatgatcccacgctggaattccgtttctgttccaaatgctatggaaattatgaatactgtcagcatcatctgtatacccatgagcatatcaagccgcctcatgaagcaggcaggtattaagacagggaaggtatttaataggaaaagtttaaaataaatatacccggacaggaaggaagaaggaatgaatcaggagcagcaatttgcaaatacactggaggaaatcaagcgcctggctaaaaaccagggaaactgtgtaggcagggagcaggtgaaggaagcctttctccctcttggctttgatgaaaaacagctggaaatggtatttgaatatctgaaagagcagaagatcggcatcggggagcctctgcagccggaggattatctgtctgctgaggaaatcaattatctggatacctatctggaaagcctggaattactggaagaactctcggcgggagaaagagaagcgataacgctctccgctatggcgggcgattatgatgccaaacagaaattaattgaaatctatctgcctcaggtagtggatatatccaagctgtatgccggacagggagcccttctggaggatttaatcggagaagggaatgtagctcttgccatggcggtggaaatgctggaaacggcaggagatattgcagaagcccagggcatgctgggaagcatgattatggaagcgatggagagttatatagccctcaatgtccaggaaaaggaaaccggcaataaaatggccgaaaaagtgaaccaggtagccgaacaggcaaaagaactggcggaaagcctggggcgcaaggtgacaatgcaggagctggcggatgaaaccggtatgacattgatggaaatcatggaagccgtacagttttccggagataatatagaagatatcaatacctcaaatgcgtaagaactgaactcggaactttaagaaaaaagggaaagaaaagaacagagggaaaatggcggatcaggattttaaatatattattcaggatttgacaaatatttatctgggggccagaagcacctatgaggagctcatggaagatgagaatgttcctcataagctgaaggaaattattgtacgtgtcatgctgacggaggttgcgccggataccactccggaaaaccatgtcttttatatggagaaggaaagcgcttcctttaaggcctataagaagatgaaggcacgttttaaaatgagtgtgtgggaaacggcagacggtaaaaaacggaaaaagtccgggtatgtgaaccgggagtattctgtggaggagattgtcggcagtagggaactgcatgaaaagaaggatacgattattgtggaggaggtacatatcagtaagctcggtctgggcgcagttattgtgtgaaggtgctgcgctgcccccgcgccaggtacccccgcttccttccctcggcttccgatttcccagccaggggattttgtattccggctgcctttggttctctgcccgtctgcgtatcatctgtgtcgacggctgcagacaaaaaaaggggctgtttctaatgttttaaacccatgttcctctgccaacgcggctgaaactcctccctttggtcgtcagacagcgccgctaagggcgggcagcggagcatgggttttaaacagtaagaaacagctccctttttttgagatgcagctgtcggcacagatgatacacagacggacagggaaccaaaggcagccggaatacaaaatcccctggctgggaaatcggaagcgggggaaggaagcgagggggacctggcgcaggggcagctagggttatgatagataaatgttaacctaataaaatatatggttgacaattgaaaaggtgcgtgatagacttccaatgtagagaggaggtcttttttgatttcctttatggcttataattttaaattcagattagggaggaaatccctggagagggagaggttgttatggagaagagagtttctacgaggtctattgtgattacgggaatgtttgctgcggtgatagcggtgcttgctcaggttgctttgcctatgccttcgggggtgccggttactttgcagacttttgctattgctttgacgggtgtggttttgggagcgaagctggggatggcggctgcgggagtgtatattttgctgggggctgtgggagttccggttttttcggggttcgcaggcggattggggattttgtttggtaaatcgggaggatttatttgggggttcctgtttttggcgcttttgtgcggattggggtgtcagataaagaataaggttgttggctgggggcttggtattgttgggttggcggtttgtcatctgttggggatatttcagtttatggtgctgatgaagatggggtttgcagaatcggctttgcttgtttcggtccctttcttgattaaggatgtggtttcggtggcttttgcttttgtgctggggcttcagataaggaagcagctgttccgtgcggatattcttcagggagcggcgcctaagaaggcgacggtggagaagccgtaaggataagtttccccgaagcaaggtgggataaatattaagggagggttttgccatgtggttttcagaaaaatgaaactacggggcaaaacccttactttttggcaaaagtcatacgatttggcgaaacctatactccgggataaaagtaaaaaattactgaaacttttttcttattatgctatacttattgaaacaaactgtgaaagaaatcaagctatgatgtcagattttaatatgtttaaatttaatggcgtataaatattggttaacaaaagatagatgattagtgtaaatgaaaataaaattagatgtcatattggatgcgattgagatggcagatgataattatacatatcttttggatttagaaacaggagaaagtgtgtttcttgcagatgaactgattactggtctggataatgagggactggaagatgaaattaatgaaaacccggaacgttatttaaggctgccaacgaaatttgagattcatgaatatcatatcatggaagaatttatctggactttaaatggtgaaagggcggataaactggaatgtgctatacgggggaggggagcatttgaagattaggtttgcggaaaaatcagtcattgaaattatggcaaaaaagtggaaaaagcatcctgacaggcagaatgctttttagagatcatgttttgttcttcgtttggcagcttcctgatatacctggttgtcagcccttacggatacaacgatgatgttcatgacgccatcatgttcttccacggagtagacaacacggataccgattccacggaatttgattttgtaaagtccggctagattcgttccgtctttatttcccagaggttttccatatccgccctgattgatggaaacaggattttggctgactttctgaattcctttaacaacctgcggctggacggaatgatcgagtcttttcatatcattcagagcttcgggaatgaatttaatttgatagttcattcgatttccacatcctccgcttcttctatttcagcctctgagatgccaaggtcggtcattgcttcatggaatggaacggtgtgctccaaaccgccattggaaatacgttcctgtgcaagcaggagaagctggtagtcttcctcaatatcggagaggcgttcgtactcttccggtgagaggatgaccgcagagggtgcgttgttttttaaaacgacaagttggcgttctgtccgcaggcggtcaaagattttggaagcctgccctttgttgaactgggtaatagaaacaaggctgtttaatacatcggcagtgatagccatttgtgattcctcctttcgctgtgcttacctttagtatatgctgaaaactaatttttatcaatagaaatattggaatatataacgcgaaattataatgtaatcattgaaaaaacgtgccagggagaggcgatccgaatctctgtcatccctcaccttggaaaccgccgctcccttaaactcttggcgaataatctttataaaacatcggaaaagtgatatacttataaaatattaccggattctgccagggaaggttatgtgccgggagccggaatgggtaaatagagacaggagatatggttacatgaaaattgaagaaatgacaagctacagactcgttgaaaaaaagaaaatagaagatttgaactctatgagttatcttctggagcacaaaaagagcggagccaggatagcgttgctttccaatgatgatgaaaataaggttttttatatcggttttcgtacgccgccggaggacagtacgggtgttgcccatattctggagcattccgtgctggaagggagccgggattttccggtaaaggatccttttattgaattggcaaaggggagcctgaatacttttctgaatgccatgacttatccggataagaccgtatatcctgtcgccagctgtaatgataaggatttccagaatctgatgcatgtgtatctggatgcggtgttttatcctaatatttataaggaacctaagatttttgagcaggagggctggcattatgagatggaaagccctgaagatgagctgagcatcaatggtgtggtatataatgaaatgaagggtgctttttcttcaccggatgatgtgctggaaagggaaataacgaatattctttttcctgatacgtcctattccaatgaatccggcggggatccggaggctattccggatctgacctatgagcagttcctggatttccacagaaaatattatcatccctccaacagctatatttatctgtacggaaatatggatatggcggaaaagctggaatatctggatgaggcgtatctgtctcattttgacagaattacagtggattcggaaatcggagtacaggctccgtttgaggcctgtgcggaggccggtaagttttatcccatcacggaaagcgagccggaggaggacaatacctatcttacttataatatagtggtgggagacagtctggatcgggaaaggtatatcgctttccagattctggattatgctctttgcagcgcgccgggagcgcctttaaagcaggctcttctggataaggggatcggaaaggatatttacagctattatgaaagcggcatccgccagtcctattttaccatagtggcgaagaatgccaatctggatcggaaggctgaatttgtagaatgtatagaagagaatttgcggagcctttctcagaagggaattgataaaaaagcgctgcgcgcaggattgaatttctatgaattccggtacagggaagcggatttcggttcttatccggcagggctcatgtatgggctccaggttctggacagctggctgtatgatgatgcaaagccttttatccatattgaagcaggggaaacctataaaaagcttcgggaaaaagcggaaacttcctattttgaagatcttatccgggaatgtatgcttgaaaatacgcacaaagggattcttaccctggcaccccggaaaggccttgccgaggaacgggacaggatattaacagagaagcttgcagcactgaaagaaagcttcggcagcgaacagatacaggaggttgtggaggaaacccatgccttgctggaatatcaggaaacgccggattccaaagaagacctggcaacgatacctcttctgaagagagaggatatccgtaaggaggcagagcctcttgtaaacgaaatccggaaaaccggagatactacggttatgtatcatgatattttcacgaaccatatcagttatttccgtttcctgttcgacgtgaagcaggttccggaggagcttttcccgtatatcggtattttgaaatcggttcttggttatgtggatacggaaaacttcacctacggagaattgttccatgaaataaacatggaaaccggaggaatcacgtcggttaccaatttctttaccaatgcccggaatctgtcggattgtcttgttaccttcgaaatgaaggcaaagactctggaggacaatcttcccaggacagtacagctggtacgggaaattatgctgaaatccaaatttgatgacggcaaacggctttatgaaattctggcggagttaaagtcaagactgcagtccaatctgatttcctccggccattccgtggcggcaagccgtgctatgtcttatttctcaaggcctgcggctatccaggagcaggtaaacgggatgcctttttatcgtcttgtggcagatctggaaaagaatttcgacagccgcagggaagatttgcagcataagctggaagctttggtacgctgtattttccgtccggagaatctgatgctggattatgtgggcacagaggatcactatgaggaattcattgcgctggccggacaggtgaaggaagctctttataaggaaccggtggagaccaaacctttcgtaattgaaccggtaaagaggaatgaaggctttctttccgcatcccaggtacagtatgtatgccgggccggtaattttataaacaagggactggcctataccggcgctctgaaggtattaaaggttatgatgagctatgaatatctgtggcaggagataagagtaaagggcggagcctacggctgcatgtgtgcattcgggaaaagcggggacagctatttcgtttcctacagagatccgaatctgaagagtacggtggaggcctatgagaaggcggctgattttatagaagcctttgacggagatgaaagaaccatgacccagtatatcatcggtgctgtcagcgaactggatacgcctttgaatcctgcggccaaaggtcttcggggcatgagctcttatcttaccaaccagacctatgaggattatcagagggaaagagatgagcttctgggggcagatgtaaatacgatccattcccttgctgctgttatcagggcattcatggaagatgactgcctgtgtgttgtgggaaatgacaacaggctgaaggaagataaagaaatgtttgacgtgctggagaacctgtattaacaggaaaaagctgcagcccaaacgcacagacagcccgcctcagcgggcaggaggtattatgaaaaaacagacaaaacttgccgggttatttatcagcttctgcctgctggctgtgatgctggcgggctgcggaagcagctccaagtcggcttcttacgagaactcttctgttgcggaagcacccgctgcctatgattccggtggtgtatattccaactatacttatgatgaggaagcagccccggaagaagccgccggtgaagaaggcggttcggttgaggttgataattcggccgcacatggcagaaagctcatcaaaaatgtagacatgactgtggaaacggaagattacagcactctggtagctgccgttcaggataaggtaaaagctcttaacggatatatagaacagtttaattcctataatgaaaacagcatcggacgccgcagtgccaatctgacgctgcgtattcctgcggagaatctggaggcattcgtatccagggtgaatgagatctccaatgttgtctcacgccaggaatccatagatgatgttactttgcagtatgtggatctggaaagccataaaaagatgctggaggaagaacagaaaaggctgcttgaactgatggaaaaagcggaaaccatggaggatatcatcaccatagagagtcgccttacggaagtgcgctatcagctggaaagcatggaagcccagctgcgtaccatggataatcaggtaaattacagtaccgtatatctgtacataaatgaagtaacccgtttgactcctccggaggaaaagggaacctgggaacgtatacgcatcggtttttccgagaatatgtatcatgtaggacacggcctcaaagaattttgtatcggtttcataatttccttgccggttctctttgtatttgctattatcattgttgttgccgtaataattataaaaattatccttcgtttcaaccggaaacgggaagaggaaaaccggaaaaaatatggtgtgccctataagccgacaggcaggcctccttacggtcccggaccgggatttgtacctcagggagcgccccggggacccatgcagggagccggtcagaatccgggtgcggacagaatgcccgccggcaacggagtcttaaacgctgaacctgccggaaaaacgaatgcggctgaacctgctgttccggacgcagggaaaaaacaggaagaaaaagaaccggaaaataaagaaccccaaaaagctgaggagaaacaataaatggatttagaggaactgctcgccgccggaaggccgctgaatgaaaagtataaatcgggatttgccacgctgattggcaggccaaatgtgggaaaatccactctgatgaacaggctggttggacagaaaatatccatcacctccaataagccgcagacaacacgtaaccggatccaggctgtatatacatcggaggaaggccagatcgtatttctggacactccgggaatcaaccgggccaagaacaagctgggaaattatatgctgaaggctgcggagggcacgctacgggatgtggatgttattttgtggctggtggagccgacgacctatataggtgccggtgaacggtatattattgagcagctgaaaaaaacaaaaacgcctgtaattcttgttatcaataaaacggatacggtcaaaaaagacgatgtgttcccggctattgatacctacaggaaggaactggattttgcggaggtggtaccggtttcggcccgctgcgggaccaatacggatactctgatttcctgtattttaaagtatcttccttatggacagccattttatgatgaggataccgtgacggatcagccggagaggcagatcgtggcggaactgatccgggaaaaagccttaaggagcctggatgaagagattccccacggcatagcagtcgctattgaaagcatgaaatacaggaaaaatattgcagatattgaagctaccattatctgtgaaaaagattctcataaagggataattatcggcaagggcggccagatgcttaagacaatcggcagcaaggcccgtcctgaaatagaagatatgcttcagtgcaaggtaaatctgcagctttgggtaaaggtaaaaaaagactggcgtgacagtgatttcctgttgaaaaattttggctacaatcctaaagacccggaatagaaaaaaataaaaaagcaaaccctattagtgtacttttttctagtacgaaatagggagcctggagctctcggaaaacagaagaggactgggtgaaggatgagcgatttaaacagctggaaacaatttgcagttacaggaaaagtggaagattatctgaaatatgcagtacatgatgcgcaaaaagacgtaggggaagggcaggaaccagaaaagaatgcaggatttgctcacggtgacaggactcatactgaaagcggaacctatcggggaatatgacagaagggtagtgatactcacaaaagagagaggcaagataactgcctttgcaagaggcgcgaggaagcagaataaccgtttccttgcgcctacgaaccctttttccttcggtgaatttcgactgtatgccggccgttcctcttataccctggcggaggctttcatttccaattactttgaaggcctccgctcagattatgagggggcttattacggaatgtattttctggaggtatgtgattactgtaccagagagaataatgatgaaagagaattgctgaagcttttataccagtcgttaagggcgttgacggcaaaaagcctggatcacgaactggtacgctacatatttgaaataaaaacagtggtaataaacggcgaatttccggggatacctgccggagaaaagctgctggactctactgtctatgccatatcctttattgcgggctcgcctgtggaaaagctttatacctttacggtgacgcctcctgtccttcgtgaactgggccgcctggcagggctgtattgcaaaaatgccctggacggacattttaaaagcctggaaattatcaacagcctttgctaagttatggttgaaaatccgggagaggtcggatataatgttaaagatatgtcaaggcacagaggtaaggaagatgaaaaaaataagtttattccttctggccgtatgcggaattgcgctgctcatggcaggctgcggttccaaagagacggaggaagatgtaagtacattggaactgaagaaaaacggggaaatcgtccatacgatcgtggaggatttcggagagagctattacgatctggatgaattaaagtcctctacagaagaaatgatagcggattataacagcagcgcaggcgcagacagggtcaaattgaattccgcccagacacaggacggtgttgtacggctggtgatgacctttaagagttcggaagattattccggattctatcggcaggctcttttttcaggaactgtcaaagaagccttcggcgccggatatgatttggatgtgacactgaacagcgttaaagaagaaggaaccacaataagcaagcaggatattcttgacatgggagataagcatgtggcgattgtccgtgagaacatcaacatcaggccctacggagatattctttatatgagctccgatgtgacgctgggagcggatgggaaaacagctgtagttaccaatggggaatctctttcctatattatatttaaatagaagaatttgcggaacaaacaggaggaaagcaatatggaaaagactatggaaaaaattgtggccctggccaaagcgagaggctttgtataccccgggtctgaaatttacggaggtctggccaatacctgggattatggcaatctgggtgtggaacttaagaataacgtaaagaaagcatggtggcagaaattcatcacctccaatccctataacgtaggtgttgattgtgctattctgatgaatccccagacatgggtggccagcggccatctcggaggcttttctgatcctcttatggattgtaaggaatgtcatgagcgtttccgcgcggataaaatcatcgaagattttgcagaagaaaataatattgagctgaacggctccgttgacggctggtcccaggaacagatgatgaattttattgaagaacataagattccctgtcctacctgcggaaaacataattttactgaaatccgtcagtttaacctgatgttcaaaaccttccagggtgtaacagaggatgctaaaaatacggtttacctgcgtccggaaacagcccagggtatttttgttaacttcaagaatgtacagcgtacttcaagaaagaaaattcctttcggtatcggacaggttggcaaatccttccgtaacgaaatcactcccggtaactttaccttccgtacccgtgagttcgagcagatggagctggaattcttctgtgagccggataccgacctggaatggtttgcttattggaagcagttctgcatcgactggctgcagactctgggaattaaagcggatgaaatgcgtgtcagagatcatgacaaggaggaattatccttctattccaaggctaccacggatattgaattccttttccccttcggatggggtgaattgtggggcatagcggacagaaccgattatgatctgtcccagcatgccaatgtttccggtcaggatttgagctattttgatgatcagaagaacaccaaatatattccttatgttatcgagccttctttgggagcggatcgtgtggttctcgctttcctttgtgccgcgtatgatgaagaggagataggggaaggggatgtacgtaccgtacttcatttccatccggcccttgcgcctgttaaaattggtatcctccctctctccaagaagctgaatgagggggctgaaaagatatatgaacagctttccaaaaaatataactgtgaatttgacgacagaggaaatatcggaaagcgttaccgccgtcaggatgaaatcggtactcctttctgtattacctatgattttgattccgaagaggatcattgcgtgaccgtacgtttccgtgattccatggaacaggaaagagtggcaattgatcagcttgactcctatttcgcggataaatttgatttctgaatgtaataaagaacagacctatacaaaagaagcctgccggctgattggtgaattcctctttaggggatgccatattccggcaggttttttgtcccatttccggcttcggcctattccgtttttcagataaatgcggttttcaaacggaaccttcagatatccctgcggtaacagaaaagaaaactacaacgaatctgtgtaccgcggacatcctccggcactggtgacgaaaccggttacagaaaagtgcagaaaaaaccacataatatttcgtttaaaacaacaaaaaaataaacgaattttttataaaaatgaattatttagtgggaagtgactgtgattaaatgttatttattggaaaaacaacaaaaattaacgtgcgttccagaaagagttgtgatataatggaaacacgagagtgaagcgcttctcaaaactggatattgacgcttcgcaaacctataccaaatatttgttcaaagggggaactaattagatggcaaaatgggtttattcattcaaagaaggcaatgcaggcatgcgggatcttcttggcggaaaaggagccaatctggcagaaatgaccaatctgggactgcctattccgcagggcttcacggtaacaacagaagcctgtaccgattattacgacaacggaaagcagatttctgaagaggtaaaggctcagatctttaccgcacttgcagagttggaagaactgcagggtaagaaattcggtgataccgaaaatccgctgctcgtatctgtacgttccggtgccagggcatctatgccgggcatgatggacaccattcttaacctgggcctcaccgatatttctgtggaaggatttgcgaagaaaaccggtaatcccagattcgcgtatgattcttaccggagatttatccagatgttttcggatgtagtcatggaagttcccaagtcattgtttgagagagtcctggatgaaatcaaagaagcgaaagacgctcatttcgacacggatttgaccgctgacgatatgaaggaagtcattgcacgcttcaaagcgatttacagggacaagatgggagaggatttccctcaggatcccaaggtacagctgatggaggctgtaaaagctgttttccgttcatgggataatgagcgcgctatcgtgtaccgccgcatgaatgacatccccggagactggggaaccgcggtcaacgtacagtccatggtattcggcaatatgggaaacacatccggaacgggagttgcctttacaaggaacccttctaccggagcaagagggatctacggtgaatatctgattaatgcacagggcgaagatgttgttgccggaatcaggactccccagccgatcacccgtctggaagaggatcttcctgaatgctataaacagtttatagaaatcgcaaataaactggaagctcactacagggacatgcaggatatggaatttaccatagaagaaggcaaactgtatttcctgcagacaagaaacggaaagagaactgcgcctgccgctttgcagattgcctgtgacctggtagacgaaggtatgataacccctgaagaggctgttctcagaattgaagccaaatctctggaccagcttctgcatcctacctttgaaccggatgcactcaaagcaggagaagtgattggacaagcccttccggcttctcccggcgctgccgcaggcaaagtatattttaccgctgaagatgccaaagaagcgcatgaaaaaggtgaaagagtcattctggtacgtctggagacctctccggaggatattgaaggaatgcatgccgcagaaggtatccttaccgtacgcgggggaatgacttcccatgcggccgtagtagccagaggtatgggaaccgcatgtatttccggctgcggtgatattgttgtggatgaagcagccaaggtattcagcctgggcggcaggacctatcacgaaggggattacatttcccttgacggttccaccggaaagatatatgacggggatattgcaacggaagatgcaaccatcagcggcaatttcggccgtattatggattgggcagattcgttccgcgtgctgaaggtacgtaccaatgcggatacgcctgaggacgcttccaatgcccttaagctgggtgcggaaggaatcgggctctgccgtacggagcatatgttctttgatcccgatcgtatcccgaagatccgcaaaatgatcctttccactacatgtgaagcgagagaaaaggctctgaatgagctgattcctttccagaagggtgacttcaagggcatctatgaggtgatgcaggacaacccggttaccatccgtttcctggatcccccgctccatgagttcgttcccacagaggaaaaagattttgaagatctggcaagggatatgaaccttacagtcgcggaagtaaaggctacatgtgacagcctgcatgaattcaatcccatgatgggacacagaggctgccgtctttctgtgacttatccggaaattgcccgtatgcagacaagggcggtaatggaagcagctattgaagtgaatgaagagaacggctatcatatcgttcctgaaatcatgattccgctggtaggagacaagaaagaattaaaatttgtcaaggaagtcgttgtggagacggctgagaaagtgaaggcggaaaagaattccgatatccaataccatatcggtactatgatcgaaattccccgtgcagcgcttctggcaaatgaaatcgctgaggaagcagaatttttctccttcggtaccaatgatttgacccagatgacctacggcttctcccgtgatgacgcaggcaagttcctggtagattattataagagtaaaatatatgaagccgatcctttcgccaaactggatcagaatggtgtgggtcagctgattaaaatggcggccaataaaggacataagacccgtcctgatatcaagcttggtatctgcggagagcatggcggtgatccttcctccattgaattctgccattccatcgggctgaattatgtatcctgttcaccgttccgtgtgcccatagcacggctggcggcggcgcaggcggcgctgaaattcccgcagcaggataaggtgtgattatcccggggcactgccgtttattctctgaagggcagtaacatttagccctggcacatagaagaaagaccttgtataatatcaatacagggtctttttctatatgctgttagtaagctcaaaggaggcggttatatgattatcaaaccagaattacttcataaaggagatgtcatcggcattgtatcaccaagccatgttgcatctgttgaagaatacgaagaaattatgtccagaatcgaaaacatggggtttcatgcaaaagcaggaaaaaacctctacaaagatacctatggctacatagcggcggaaaacgaacgtgcggatgattttaatgaaatggtaaatgatcctgccgttaagatggttttctttggaggaggggaagggagcattgatttgcttcctctgattgattatgccgccgtcagaaagcagcccaaaatatatgtaagctacagcgacgggacctccatattgaatgccatttacaacaggaccgggctgacaacatattacggtcagacaccggggctgcttaaggatttgcgccattatgattacatgcagttcgctgctcacttcctggatggaaatgttacctcattcacacgcaacagcaagtggcatatattaaatccgggcgtttgcagaggaaggcttgtaggaggatatttattaaactatgcgcttttgctgaacagtccttttttcaattacggcaatgctgaaaaatatatcttgtttttagaagattatgagcagttcaatgatattggaacggtgagcatgctgatctcacatatagaacagagtgattttgctgatcatatctcgggactgctgttcggacattattctgagtcaatacatcctgaattgatggagcgcctgaaacgctttggggcaaaacatgatgtgccggtggtctattgcgatgatttcggtcatggtaataaccatgcaatactgccgattggctgcgacgcagcattagataccgggaaatgtgaattgttatttattggataaccagaaaaatccctatgccggttaattcccggtataaggattttttgtttttctttttttgttatgccgtcatgattgcttctgcctgtgggtattccttatttagcacctgacttaatgtccggagtacactgtacaaaccggaatggctaggttataattaaagaggttgttttatgctcgcatataggaatacatacattataagacgataatacatctgccttgagggacgcaatgataacggaaaaaagactgaaaaaacagatcacaattgcggcagttacggcggccggcatatttgcagccttggcagtcactgcaattatggcctttattaccctgaacagggcgcaggaaaatgaggctgagatctatttgaacgaagtgacggaacaatataaaagtaccattgtgacgcagatggaaggctatcttcatgtgctggaggccctgtcgaccattctgggagaaaaggaaatggaagaggatgagattctggatatccttgaaattgaaaattaccagaatgattttattcgtatggggtttgtgggaactgacggcatcggtgaattggtggatatggacggtgtgcgctatgaaaacgtccttctgggagaggaagagtttatacaggatgccatgaaaggcaattcggtggtttccaataccatgcgggatcggtttgacgatggttatattaactgctatggggtacctgtttacagaaagggggaacttctgggagtgcttaccgctgccagtgaatatgaaagcttcgggaagatcatcagccgtcccatattcaatggaagcgcatatctgcatatcattgacagcaacggagatttcgtaatccgttccggccataagctgattgaaaacgaagattgccagaatatttttgatatagatcttctgggagcggggattgaggaaaatctgctgtcccggctgaaaacaggagagaccttcttttccggtttcacacgtaataataccaaattctgggtgttttttgctcctatagagagaaacggctggtatttggtgtgtatgattccgcagaaggcgctgaatgcgaattttaacagaatgacccgtgtggcaatcgccgttttttccattatcattttactgcttgtcattctgtttgcctatatttatatgcttatccgcaataaccggaatgaaatgcgcaggctcgcctattatgacccgcttaccggtctctataataaagcccggtttgtagaagaagccatgtcccttttgaaactgaagagtgactatgcgctggtgcttctggatgttgtcaactttaaatttgtgaatgagcttttcggatatgaaaaaggggacgtcctgctgagacatgtcgcgcaggtatgcatggatgctatagacagtaccgagctatgctgcagagacaattccgataaatttgccctgcttatgtcatatggtgaaaagcaggctttgacggacaggttaaccaaggttatggaaagcatttcgcgctgccagctggatcccgttcaggagtaccgcatcctgtgcaactgcggcgtgaaaacagttgaaaattataacggcagggttgattttgatgtcttttgggacagggcggatctggccttgaaaaatgccaaggggaatcagaatgacgctattattttttatggtgaggaactgcatgaaagggaagtaaagcgcaatgagatagaacgtattatgcatacagcgctgagcaacagggaataccgcatgtatctgcagcccaaggtcgatctggtaagcgggagggtctgcggtgcagaggctcttgtacggtgggtgcgtccccggggcgggatgatttacccggatgaatttatcccggtatttgagcagaacgggttcattacgaaccttgatatgtatatgctggaagaagcatgtgtttatctgaacggccttcttaaaatgggaatatccggaatctgtatttcggttaatcagtcgagaatccttttttacaagcaggattatttgaagcagattgaaaaaataataagaaaacaccatattgatccctctcttattatattggaggttacggaggggattacgatggaaaatctggaggaaatgaaacgacttgtcagggaactgcataaaatgggttttgccgtgtccatggatgatttcggaagcgggtattcctccctcaatatcctgaaggaactggatatcgatgaactcaagctggataaagcttttcttgccgatacaggagagcaggaaaagagggacattatcatgaaaaatatcattaacctggccggggagcttcatataaaaacggtgactgagggcgtggaatgtgcatctcaggcagattttatccgttccattcattgtgatatcggtcagggctattattatgcaaaacctatgccggaggatgaatttaccagattcataacaggaaaggcctgaagcgaatgaaaatattattgattattgatcagtatgacagagggaataacgggactaccatgactgcccagagactggcgcatacgctgtcggctcatgggcatgaggtgcgagtggtgagtacggggaattcgggaaatggaaaataccttgtaaaagaatattttctgccgcccattgtccgtcatattgtgacaaaacaggggatggtatttgccaggccggatgaagaagtgttgagggaggccatcagctgggccgatctggttcattttctgctgcctttccggctgagtatgaaggggctggaaattgcgcgggaactggatgtcccccatacggcggcttttcatgtacagccggaaaacatcacctataccctgcatctgggaaaacagcaggctgtaaacgcctggctttaccgtttcttctgggatcggttttataaatatttccgtcatattcattgtcccagcagctttatcgccggggagctgaaggcgaatcattatacctcaaagcttcatgtcatatccaatggcgtggatccggattttatatatcagaaaaggccgaagccggaaaagctgaaggacaaatatgtagtgcttatgatcggaaggctttccaatgagaagaggcaggatattctcatagatgcgatagccaaatccagatatgaatcccgtatccagcttgtgctcgcaggccagggactgaaatacggaagctaccggtatcgttccagaaagcttacaaacaagccgatcatgcgtttcttctcccatgaaaagcttcttcagcttctttctgagaccgatttgtatgttcatgcggcagatgcggagatagaggccatatcctgtattgaagctttttccagcggcattgtaccggtgatcgcagacagccccaaatcggctactccgcagtttgccctggatgagagaagtctgtttaaggcaggggacagcgatgatctggctgcgaaaatcgattactggcttgaggagacagaggaacgcaggcggatggaaaagctgtacagtgaacatggcaaagaatttgccctggatgactgtgtacgccgtatggaacagatgtttgaggaggagcttcaggattcctggaaggaaaaactccgcatggagaaccgaaggaaatttgcggagggaaaaacagagacggcgggtgttgtctatgaggaaaaacacattgtaaaaatgtggacgcctattccttttcatgtgaaggattcctatcactttttccccacaaaccccttcttcatattaggaggaggccttgtccggcttttgatttatctgctggtatttctgtttatcaagccgatatgggggctgaaaatagaaggcggaagtaatctgaaaggaataaagggcggggcggtcactgtatgcaaccatgtgcacctgctggactgtgtgatggtgtcctatgtgctgcggcataaaaatgtctgcttccctaccttggaatccaatttccgcatcccgcttatccggcatatcatacgcctgctgggagggattcccatccccgagaacaggcaggtattcaggcggtttatggaagaaaccggaaactgggtggccggaggcaattggatccattattatccggaggttgtcctgcatccttattatcagggaatacggggatttaagcggggagcgtttctgacagcctgcgaagcgggagtcccggttatccccatggtgatttcttacaggcatccgggaggaatagcgggcctgctccggagaaagccgtgccttaccctgaaaatactgccgcctgtagcccctccctccggcgggaacaaaagagcgcagaccatgcagctgatggataccgtgtacaatgtgatgaataaagcttactgggagtaagcgtaagaaaagaagaggagttttatgataaagaacgaaagaaaagtcattgatttggctgggatgcttaagattgtggacagctgtgatatatgcaggctgggccttgcggaaggtaatcggatagccatcgttcccatgacctttggctataccttcctggacgggaaattcactttttattttaagggtgatttggaagaggagaggctggcattgatccggaatgcagaagaaattgactttcagatggattccgatcactgtatgctgcccatgggaaacggagaatataccatgttctataatcatggggaaggctatggaaaaccggttttcctggaagatgaggaagaaaagaagaaggcgatgaagcaccttcttgctcattatcttcccggcgaggatgaggcattcgatgatatttcatggaaggaaacctgtgtgttcaaactggaagtaataaagctgcactgtaaagtcagcaaatagcaggataattattctgcaggctcggtatctgaaggctcagcggtattttccggttctccggcattgtcaaaattatcggaattcccttctgagtcttccttaaaaccgggggcatcattttccgtaatgatggtaatggaatcgtcggtaggcatttctccctggagaatcagggaaatataattaagcctttttaccgcacggttgtaatactccaaagcggcggaagccacattttcattatattcttcatcggcataggcttctctgtacagacgggctgcctctgtcatgttttctccggcctcatcggccaggtcttccactgcggaaaactgtctgggcacttcgatatccgcaagcaccgtgaattgggccgcaagatcatccatggcggcaagcatatcctcaacgccggtttccgattcgggatccacactgttgagattgtcgaaggaaatgttaacctgggcggtaaaatcatccatctcactgtaaaatttatctaattctgcatttttgccgcagcctgccaaaagagcagaaacgagcagaacggcggtaagcagacatgtcttttttccttttttcatccttggtatacctttctggccaccggtcaaaagaggtgccggtgaatttcataatcagggagcaaaagtctctattcaacttaccatattatccgcatgaaatcaagtgaggaaagatttctgtagcgggtgctttctttttgctttgtttcatgttagaatgtaacatatttacaaacggagaacaagctatgacgaaacaggaattcagggaatttattaaggacagaatggtctttctggatggagccacaggttccaatctgatgctcagagggatgccgggaggcgtttgcccggaaaaatggataatggaaaacacacaggtgctgatcggtcttcagaaggaatatgttgccgccggcgctaatattttatatgcacctacttttacggcaaaccggtgcaaattaaaggaatacggcctggaaggacagcttcggcagataaatgccgtgatggtggctgcgtccagagaggcggcaggcggaaaagccctggtggcaggtgatctgactatgacaggggaacagctggcgcccatcggcagtatggactttgaagaattgattgatatatataaagaacagattgcatgcattaaagaggcgggagcggatcttttggtggtggaaaccatgatgagcctgcaggaatccagagccgctctgctggcggcaaaggaaatctgccctggtttgccggtaatggttaccatgacctttgaaggggacgggaggagcctgtacggaacggacgcggcgacggcggccgtggttctggaaagcctgggtgccgcggcgataggagccaactgctccacagggccggagcaaatggctggaattatacggcagatggcgtcggtaacacggatccctgtgattgcgaagcctaatgcggggctgccgtccctgaacgaagagggaaaaacggtatatgagatgcggccccgggaatttgcggaagagatgcaggcggtttatgaggccggggcttcgattataggaggctgctgcggaaccacgccggagcatattgcagacctgcatgaaagcttcgctgggaaaatgcctgcacaggtgaacagaaggccttccgggatccggtatctgacctccgaaagaaaaacgattgctttcggtctggacgatccgtttcttatcatcggagaaaggattaatccgacgggaaagaaaaagctgcaggcgcagctgcgggaaggcagctttgagatggttacccgtttcgcggaggaacaggaggcaggcggagcgtctgttctggatgtgaacatgggaatgagcggcattgatgagaaagaaatgatgctgcgcgccctggaagaagtgggaggcgtaagccagctgccgctgtctctggattccagtcatgtggaggtcctggaagcagcccttcgccgttatcccggaagagcgctcatcaattctatttccctggaaaaggaaaaattcgagaagctgatacctatggctcaaaaatatggggccatgtttattctactgcctctttccgatgcgggacttcccgagagcctgcaggaaaagaaagagataatagaaaccatactggaacgggcctttgcatgcggcctggctaaagaagatatcattgtggacggtctggtcactactgtgggagccaatcccaaagcggctctggaaacgctggaaaccatccgttactgtaaagaaaaacagctggccactgtctgcgggctgtccaacatctcctttgggcttccggaacgcagctatgtgaacagtgttttccttaccatggcaattcaggcagggctgacgatggcaattgccaatccctcccaagagctgcttgtggccagtgcatttgcttcggatatgctgctgtgtaaagaggaaagcgctctgcggtacattgaatatgcgggaacctgtaccggtatcaaacctgtttcctcagcggccccaaccgctgaaaactcaggtcagaaggagaataatccgggacggcagtcttccggaaacgggggctccgggacggcggcttccggagagaaatcttccggtgaaaaatttcccttttcggcggtctatgaagccgttctgaaaggaaaccgaagcgggatcgaacagatcacccgaagggcgctggaagagggcgcttcggccagagaacttctggatacctgtctgctgcctgccatcaatcaggtcggtgagctttttgataaaggaaagtacttccttccccagctgatttccagcgcggaagccatgaaattatctatcggggttttggagccccttctttcctccgatggaaagcaggagaagatgccggtggtggtgatcgccactgtggaaggtgacatccatgacatcggtaaaaacctggtggccctcatgctgcgcaattacgggtttgaggtaatcgatctgggaaaagatgtgccgaaggaaaagataatacaggcggctaaggagcacggggcgggtatcatagggctttctgccctgatgactactaccatgcaggaaatgcgccatgtggtggagttggcgcatgaagaggggctggattccaaaatcattatcggcggcgcggtggtcacccaggactatgcggatgaaatccatgcggatggttatgccaaagatgcggcagatacggtgaggctggcgaaacggctgcttggccttaatgaggaaacgcagggggacagccatggaaatgaatgacagaacggaacaggcggaagagctgtgggatgatttgcccacggacagtcagcatgaaaccttatgggaagcggaaggaacggagctggcggtgagacagctcatggatcagctgaaggcttccgaggaaaaacagcagggccttatgaagaaacagctcctgtttacccggatttttgctgtttccaattgtgttctggtgcttcttgtcctgatcttcgtggcgggagtgctgcccaggctgacgacagccctggataaggcaacggaatcacttgttaaggtggacggagcgcttgatgatttcgggaaggtattcgataatgtaaattctctggtggattccagcagtaaggccgtggagcagacaatggataaggtggatcagatggatattgagagtctgaataacgcaatttccgatttaaacgatgtggtggcccccatggcagaatttttcggcagattcagataagcgggcagtcttttgaggcctgcggaaattaaggataaacagataaacggagggattggaagatgaatggtgcggatgcgattgtaaagtgtctggaattggaaggaataacggaagttttcggttatcccggcgttgctatctgccctttttacaacagtattcttgattctgatatcagtactgttttaatcaggacagagcagaatgcggcccatgccgcgagcggacttgccagggtgacaggaaaggttggtgtgtgtgccgtaacgtcaggccccggcgccacaaacctcattaccggtattgccacagcttttgccgacagcattccccttgtctgcataaccggccaggtaaacagcgaacttctcggaagcgatgtgtttcaggaagctgatatcaccggagcggcagagtcctttgtgaaatacagctacctcataagagacgtgaatgatatcccccgggtattcaaagaagctttttatgtggcaaatacgggaagaaagggccctgttctcattgatatccccattgatgtacagaacgctgtgataaacaaattccgttatccggaagaagtgaatatgagaacctataagcccactgtaaaagggcatattgtccagataaagaaagtaatgcgggagctggaaaaagcaaaaaggcctttgatttatgcaggcggcggcgttactctgagcggggcctgtgaagagcttcggaaattttcggagaaattccgaatccctgtggtttccaccatgatggggatcggagttatgcctacagagcatcccatgtatttcggtatggtgggaaataacggaaaaccctatgccaaccgcgccatgaatgaatcggatcttctgattatggtaggtgcccgcgtggcggaccgttccgtaaatcagccggatttgatcacccatgataaagtgctggtgcacattgatgtggatcccgctgaaataggtaagaatgccggtcccaccattccgttggtgggagatgccagacatatttttgaagacttcgaaaaacaggaatttgaatgtgaacatgaagaatggctggaagcgctggatggctaccgcaggaatatgaagcttgtccgccgtccgaatccggaatatgtggatccggaagagctgattcatcagatatcctataaaatgaagccggacggcgtctatgtggcagacgtgggacagaatcagatatggtcctgtgctttccatgtggtgagggaagggcgtttcctcacttccggcggcatgggaaccatgggctattccatcccggctgcgatgggcgccaagctgggcgatatgtccaagcaggtaattgcggtatgcggagacggttccttccagatgtccatgatggagctggctaccatccagcagtatcatattccggtaaagatcgtggtattccggaacaattatctgggaatggtccgggaataccagcactattcctataaagacagctactcggtagttgatatttcaggcgttccccatctggataaactggcgcaggcttatgatatcccttatatccgtgtggcccggaatgaagatattgacggggctttggacgatttcctgaaggatgactgttcttatctgatggaatgtatgatagatcccatggatttggtgaaataaattttgatccggtctaataccgtccgggaacggaaagaaaagaggtttggcaatgaaaaaaatatattctgttcttgttgaaaacagatccggcgttctgtgcaaggtagccggcctgttttccagaagatgctttaatatcaattccctggctgtgggtgaaacggatgatccggccgtatcctgtatgaccattgtcagcagcggcgaccagcgtaccattgaacagatcgaaaagcagcttaataaaaagctggatgttatcaaggtgaagacctttgacgagaactccagtgtaagccgggagctgatgctggtgaaaattaaatataacaggaataaccgcaaggatattatggaaaactgtgcgattatgcatgcttccatagtggatatgtcaaagcacatgatgctgatccagatttgcgatactccggaaagggtacagcttttccttacgatgctgcagtctatcagcattgtggaggtggcgagaaccgggactctggctctccccaaatgtatggaaagcgatatctgaaaagcggcccgccttgtataacgtacattacagacttcagtactgactataacctggagttataaaaagtatgactgactatcatacgttgacaaggtgtataaatgttgctagaataattggaaagacagcaccggcgggactttaacgtcccttgtgcaggaggggcgtgatacatatgcgaaaaaaagtttttcagcttcttgtggataatacctcaggggttttgagccgtatatccggactgttttcaaggcgcggctataatattgaaaccattacggcgggcgtgactgcggatcccaggattaccaggattaccattgtagccaatggggatgatgagattctggaacaaatcgagaagcaggtatccaagcttgtggatgtgcgggatatcagggagcttaagcctgaagaaagcgtttaccgcgaactggcgctgattaaagtcagtgtttccgcggaaaaaaggcaggatgtaatagcaatcaccaatattttccgggccaatattattgatgtgggacaggaaagcctgattgtggaaattacaggcaaccagagcaaggtggatgcgtgcatcaatcttctgagcaattatgagattcttgaactggcaagaacgggcattgcaggcctgggacgcggaacaggaaatgttgtatatctggatccgctggattgatttattgttgtggactctgaggttcagccatccgctgcggcctttcagttatatagtcattcaaactaaatggaggaaagaaaaatggcaaagatttattatcaggaggattgtgacctgtcattattacaggataaaacaatcgcagtaatcggttacggcagccagggacatgcacatgccctgaatctgaaggagtctggctgtaacgtcattgtaggactttatgaaggttccaaatcctgggcaaaggcagaagctcagggccttacagtatatacagctgctgaagctgctaagaaagcagatatcatcatgattcttattaatgatgagaagcagggcgctctttacaaagaatccatcgaacccaacttaagacccggtatgatgcttatgttcgcacatggcttctccatccatttcggacagattaagcctcccgcagatgttgatgttgccatgatcgcacctaagggacccggacataccgtaagaagcgaatatcaggccggcaagggtgttccctgtctgatcgcggttgctcaggatgctacgggaaaagcaaatgatctcgctctggcatatgcactgggaatcggcggggcaagagcaggcgttctgcgtaccaccttccgtgaagaaaccgaaacagatctgttcggtgagcaggcagttctctgcggcggcgtatgcgctctgatgaaggctggtttcgaaactctggttgaagcaggatatgagccggaaagcgcatattttgaatgtatccatgaaatgaagctgatcgttgacctgatttatgaaagcggattcgccggaatgagatattccatttccaacacggctgaatacggcgattatattaccgggcccaagatcgttaccgaagataccaagaaggctatgaagaaggttctttccgatatccaggatggttcctttgcaaaggaatggctgctggagaaccaggttggatgccctcacttcaatgcaatgagaaagagagaaggcgctcatcagctggagaagaccggtgcggagctgcgtaagctttacagctggaatgataccaacaagctgatcgataactaatcggacaataagaacggaaaacaagaggaacgggctgccaatacggcaatccgttcctttttcacgtgactgtttaaagattaaaagaagcaggttttatacatgcttcatacagaaatctgaaaacttttctgcggtggcggagcaggtctgatttttcaggtaggcgaagcccaccttccgggaagggacggataccggcagcggaaggctgatgagtttgccggtatccagttcctcctgtacaaaatcttcaatcacacaggctatccccagatcgattttggcgaaatcaatgagcagatccatggatgtgatttctatagtctgggcggcagtgatttcttcctttaccagatatttttccatgtactgccttgtgatgttctccttatcaagcagcatcagggtggagtgagagatgatatccctggaggaggggctgccggaaaaggagactcttttgcacagattgtccagataccgctgtgtgcagacgaaaacatcccggatttcttgtaccggatgaaaatggaatttatccatcctgtcattctctccgataaggccgatatctaccgtccctttttccagagcttccatcgtctgatatgtggactggcaggaaatggatatctgaatatgagggttttcccgtgtaaaaaggctcaggtgaggaagaagaacatatttgcacagtgtggtgcttactccgatggacagatgccccattcccagttcctgcaccttacgcagctgttcctcaccctggctgatagcctgaaatgcactttccacctgacggaacagaagctcaccggtttcggtcagccgtactcctctggaagaacgcagaaacagagtcgtgtccagattctgttccagccgggatatggctttgctgatagcgggctggctgatgaaaagctgtcttgccgcaccggaaatattcctgcacttggcaaccgtataaaaaatatgatacaaattcagattctgttccattcgaaatcctcctgccgtccggcgtctccatccggtgctgtacacacactgcggaagcctgtcttctataactatattgcattttataaaattatactataacttgaaattatagtaaacatgaaagaaaagtattttcccaataacaggtgttatgttacactattaacatcgaagggccgggatggcctgaaccaatggaaacggaggaaagaaaaatgggtatgacaatgacacagaagattctggcagcccatgcaggcctggaaaaagtagaagcgggccagctgattgaggcggatctggatctggtgcttggaaatgatattaccagtccggttgcgattaaggaaatggaaaagatgaaggtagacggcgtttttgataaagataaaatcgccctggtaccggatcactttgtccccaacaaggatattaaatccgcagagcactgcaaatgtgtgagggaatttgcttaccgcaatcagattaccaattactttgaagtgggtgaaatgggaatcgagcatgcgcttcttccggaaaaaggccttgtggtagccggagatgtagtgatcggagcggattcccatacctgtacatatggcgcgcttggcgctttttccaccggtgtgggaagtacggatatggcggcaggaatggcaaccggcaaagcatggtttaaggttcccggagccatcaggttcaacctcaccggaaagctttccccatgggtgagcggcaaggatgtgattctgcatatcatcggaaaaatcggtgttgacggcgctctttataaatccatggaatttgtgggcgaaggagtatcgggcctgaccatggatgaccgttttaccattgccaatatggcgattgaggccggcggcaagaacggtattttcccggtggatgatcaggcgcttctttatatgaaggagcattccatgaaaactcccgtcatttacgaggcggatgaggatgcggtatatgaggaagaatatacgatcgatctgggagctctgcgtcccacaatcgcgttccctcatcttcctgaaaacgcgaagacaattgatgaaataaaagaagatgtaaaaatagatcaggtagttatcggttcctgtacaaacggacgtatcggagatctccgctgtgctgccgaggtgctgaaaggccgccatgtggcacagggcatccgctgcatcattattcctgccacacaggctatttatctgcaggcgatggaagaagggcttctgaagatttttatcgaagtgggagcaattgtcagcacgcctacctgcggcccctgccttggaggatatatgggagttctcgccgccggagagaggtgtgtgtccacaacgaaccgtaactttgtaggacgcatgggacatgtggattccgaggtctatctggcgagcccggccgtggccgcagcaagcgccgtaacaggaaagatttccagcccggaacagctgtgagcgcaggtccggtttacagaacgaaaatgccgaagaagggcagaaggtgaggttttttatgattaatgcaaaaggaaccgttttcaaatacggtgataacgtagatacagatgtaattattcccgcccgctatctgaattcatcagatcctgcggagcttgccactcactgcatggaggatattgacaaggactttattaagacagtgaaaaaaggcgatattatcgttgcggaaaagaattttggctgcggatcctccagggagcatgctcccattgccatcaaagccgccggcgtaagctgtgtgattgcggaaacctttgcccgtattttttatcgcaatgccatcaatatagggcttcctatcatcgaatgcccggaggcatcccgcgccattgaagcgggagatgaggttgaagtggattttgattccggtattattacggatatcacaaaaggaaccagctttaagggtcaggcttttcctgagtttatgcagaaaatcattgatgcggaaggccttgtaaattatattaataataaggcatgaaggtaacaccgatgttcctcagatgctgatccgtatttcacagaattaaaataagaccgcatggctgcgttgattcggcagccatgcggtctcgctgtataaaaaagaaggacagcacattcagtttttcttttcttctccataataaaggattcccagggcgccagggccggcatgggttccgatactgggactgatatcattgatgatgatatctgtgatccctgtaagctcggtgacaaaatcagccgccatacgggcgtcttccgggcagttcccgtgaacaatacctaccggcacggttttatcgggagcgtcgcccagggtgtttttcattctttcagcaagtgtgcggatggatttcttccttcccctggaagtgccgtcagacaccaggtttccgttggttcccacatataggaaaggcttcaggttcaatgctgttcccaccgcggcaacggcgccggatatccgtccgcctctttttaaatggaacaaatcatccaccgtaaactgcacatgcagatgttttttatattcttccagcaaagccgcattttcttccagagtttttcccttctccagaaagtggtttgccttaattacgaggatcgtttcagcaagggatacgttcagggaatccaggacaatgatttttctgtcaggatattcttcacacagttcctgtgcggtaacatatacattattatagctgccgctcagcgcggaagaaaaagcgatatgtaaaatatccattcctttttccaggatctgttcgaatttttctctgataactgccggattattagccatggatgagggaagctcgccctgtttcatacgctcataaaattctgccggaggcatatttttctcatccccgtatacctcgtcgccgaaagcataatactggggaataatagtggttccgaatttttccttataagaagacggaagatcggaattggaatcggtggtaatacaataattttgcataaaagacctctcctgtgtatgctgcattcaaatgatttgattttcaaaacaataatgattataacggttttcttaacttatgtcaatgaatggtacatagcaggtgcaggcagaaaaagtgaatgccgccgtctgtgcccctgccgccttccctcactgcccggttccgtcctcccggctcccttgtcccggatacgggcggctgccctgcaaggattccagaaaggggcgtcataagctcgccggtccttaggctgcgtattttgcagccttagtaccgttgcgtgattatccgagcggaagcgtcccctttacggaaccttgcagggcagccgcccgtatccgggacaagggagccgggaggacggaaccgggcagcgagggaaggcggcaggggcacggtcggcggcattcactttttctgcctgcacctgtatatagctatacgatatctttgatgcatgcgtaaaacatttttccatgacttttgggacaagatggtgtaaaataggagggaaatgttgtttatgggaaatttattacggaattgggaaggactgttgcggaaatgagttttaaagaagatgtttttgctaaggtaattacctatattactatcgcggtgttgctgggagcgatgctggtggaggcgtttgttatttatacggagcgcagtgaaaaaaaggatctggaaacaaggctgacgagtgcccaggagacggtagggagtctgtctcagctgaatgtcagtctgcagaaggagaatcaggagcttcaggagtttaaaaacaactgggagaatctggtgattgtggcggatgatgaggtttgtcaggcgctgcgtgaggatctttacgcccggcccgaactgataccgcaggaagccatagaagattcttttgccccggataaggaagaattgtctgaaggaggaagggcagacaatacttctttggaagagcttcttgaagaggcggactttgtttttccgtcgcctgatgaaaaagaatggttccttccgctgaatctgggcaacaagcccagtgtggaatatcttttttatgccagggcggttgacgaggagagggatcgttacatcgatcttttatatgaggtgcctgtaaggggagaggatgagaagccccttacggatgaagacggagaaattatctggaaatgtatggcctatgacgcaggtcttggctggcagattgttgcagaggaagaggaatagatgagaacaatcgataagatattcgaagaactgaaggaaatgacagacggacagagatgggacgaggtggagcctttcctgacggggtgtctggatgaagcacgggaagaggaaaattacggtatttatataggaaccgggaatgagcttctccggttttaccgggaaacagagcagtttaagaaggcgctggatctgtcggaggatctgttgctgctgatggaagaacttcagctggatgaaacggaacattttgccaccgtgatgctcaatgtggcggctgcctgtcaggcggccgggagggcggaagaggcccgccgctattatgtccgtgcgctgaaaatactggagagcaagccggaaacggaggaggtaagggcggatatctttacgcagatggctctgctgtttatgaatcaggataattatgaagaaggggaggccatgctgaagcaggcgcttccgctgtatgaacagctggcggatgtacaggaaacagatcgggaaagagaaatgaaccgtcatatacattattccaccgtgctgtcagggctgggagaggcttcttaccgcaggaaggattatgcggatgccctttcctattatgaaaaagccgccgctttaagccagaaatgttttggagaatccgaggggacccggctcttaagggagaactgtgcctccatagcaaggcagctgggagacgaagagaaatcggcttattatatcggtttgaaccgaaaggaggaaccgcttccttgaaacatatgttcaggcatggtataatcacgaaagcggattttttactcattgccgcagtgctgatcgcagcatctgttattatagccgtacggactgccggcaggacggaagaaggctgggtggtagtcagccgtgatggtgttgaggaagagaggctttctcttaaggaagataccaggctccttctccgggatgaagaaggaaatgaaaatcttctcgtcattgaaaaggaaagtgtatggatagaagaggcgaactgccctgacggtctgtgtgtcagacaggggcatatcagccattccggagacagtatcatatgtcttcctcacaagctggtggttacgattgaggggacggaaaagaatacttccggatcggacgcgatggttaattagggatgaatcatgaaaaaaacggctttactcagtatgcttctggcatttgccctgattttgggctatgtggaaaccttaatccctctgcccttcggcatgccggggatgaaattgggcctgcccaatcttgcggtgctgattacgatgtaccgtttcggaaataaagaagctcttacagtcaatgccgcgcgggtttttctcagcggttttctgttcggtaatttttcggccattctttatagcctttcgggggcggcagtcagctttcttgtgatggcgggctgtaagaaactttcctttttttctgtgacaggagtgagtgcggcaggcgggatcgcccataactgcgcccagctgctggtagccatgctggtggtgcagacaaggcagacgatgtattatctgccctatctgatggcggccggctgtgtaactggcctttgcctcggactggttgcaggacaggtactggagcggcttccgaatggcgggcatacggcataaggatttcgggttcagcaggccgcggaaatacgggaaggcgcagcggtcaggctgcgcggataggagaagcaatgtttgcatatttgatcggcaggatcgccgatatttcagaagataatcttgtgctggaggtaaacaatataggttttaatgtaaaaattccttccggcatacatggtcttttacccggtctgggagaggaagtgaaaatacatacctacacctgtgtgagggaggattcctttcagctgtatggttttttaacaaaggatgatctggacatgttccgtctcctcatcacagtcaatggtatcggtccaaagggcgggctggctgtcctgtctgttctgagcgcggatgatatccgtatggctgtgctttcacaggacgccaaaacgattgccagggctcccggaatcggcgctaaaacggcgcagagggtaatccttgatttgaaggacaaggtttctctggaggacacctttgtggcgaaggaaagcgccgcctatacggaaagtctttccggcctgacggaaagcagaaacgaggcggtggaagcattgactgccctgggctattctgctacggaagcgcttcgtgccgtgaagaaggtcgaaaacgcggaaagtatggacgtaggggaactgctgaaagcggccttaaagcatattatataggaagagcctgagcatggaatgccagcttccagggaaggtgcggaggaatcagatgccaagagtgatagaaaccaatattacggaagaagatatccggatggaagggacactgcgtccccaaagcctggatgattatatcggtcaggaaaaagcgaaacagaacctgaaggtttatatagaggcggcaaaacgacggggggatgccctggatcatgtcctgctttacgggcctcccggcctgggaaaaactacccttgcaggcattatagccaatgagatgggtgtgaatatgaaggtgaccagcggcccggcaattgaaaagcccggggagatggccgccatcctgaataacctccaggaaggggatctgttgtttgtagatgaaatccatcgtctgaaccgtcaggtggaggaagtcctttatcccgccatggaggattatgtcattgatattatgatcgggaagggcgcttccgcccgttccatccgtctcgatctgcctcatttcacgcttgtgggggcaaccacgagagccgggctgcttacggcgccccttcgtgaccgtttcggggtcatacaccgcctggaattttatacggtggatgaattgaggaaaatagtcattcattcggccaggattctggatgtggaaattgatgagggcggggcaggggaactggccagaagaagcaggggaacgccccggcttgcaaaccggcttctgaaaagagtgagggatttcgcccaggtccgttttgacggagtcataacaaaggatgtggcgaatcaggcgctggatcttctggatgtggataaaatggggctggatcacgtggatcggagcatgctggataccatgatttataaattcagcggcgggccggtgggactggataccctcgcggcggccatcggagaggatgcggggacgatcgaagaggtttatgagccttatctgctgaaaaacgggtttattaacaggactccgaggggtagagtggtgacggaattgacctatcatcatttagggcttgaaattccggagtagtttgtctataattaattctatataaaatgaaaatacaatttccggatattgtatgaaggagcaaatgaatggccgttaagacagatacagaagtgatcataggtggcaaggtatttactctgagcggttatgagagtgaggaatatctgcagaaggtggcctcctacattaataacaaaatgtcagaatacagtaagctggacagcttccgaagacagccggtggacaggcagaatgtcctgcttcagctgaatattgcggatgattactttaaggccagaaagcagattgcacttttggaagaagatatccgggccaaggaaaaggaactgtatgatttaaagcatgagctgattgcctctcagatcaagctggaaaattcagagaagtctctgaaaggcctgcagcgtgatttgaatgaaagctccaagaaaatcatacgtctggaaaccgaactggccgacaataagaaaaaaggaaacggggatcccagacagaaatagggactcgtttttataagagaatatgtttacggattcatgtgtataaaggctgtctataaaggacagcttttttatatccgtatctttgtcagggaaaggaagacagatggaaacagctacgaaaaaaccggaattactggcgcccgcaggagactattcctgtttcagggcggctttaaaggcaggagccgatgctgtctatatagggggacagaaattcggtgccagagcttttgcgggaaacttcagtgatgaggaagtagtggaggcgctgaaagaagcgcatttctatgggaaaaagctttatcttaccgtaaatacactgcttaagcaggaagaaatcaaacagcttccggattttatggagcctttttataaggccgggctggatggcgttattatacaggatatcggggctctttcccttctcgggaactgttttcccggactggagcttcacgccagcacacagatgacggttaccgatgtgagaggggccgtattccttcagaagctcggggtatccagagtggttcccgcaagggagctgactctgccggaggtggaagccttatgccgtgaaagcggtatggaggtggaggcctttattcacggggccatgtgctactgctattccggacaatgtctgttcagcagcctgctgggcggacgcagcggcaacaggggaagatgtgcccagccctgccgccagccatatcgtatcctgacagaaaaagcaggagatgaatgctatcccttaagccttaaggatatgtgtaccatacaatttctgccggagctgatcaaggccggtatcgattcctttaaaattgaaggccggatgaaaaaaccggaatatgtggccggtgtcacaagtgtataccggcgcaggatagattcgttcctggctgatccggaaaatgacaagggggtttccgaaaaggatatgcatatgctttcctctttgtatattcgaagcgaaatcagcggaggctattattaccggcataacggaaaagagatggtgacattaaaacagcccggatatgcgggctgtgatgatgaggtactgcgtgcggtgcagacggagcttctggataaggagctctctgtcccggtagttctgaaggcttatctgcatcccgaagcccccctgcgtctggaagcctggataatgggagaagcggagcacgaagaagacggcgttgcggccggctcttccgttttcctggaagggcagatggtgcagacggcatccaaccgaccgctcagtccggccgatgtacaaaagcagctgggaaaaacaggagggagcggtttccgggcggaacgtatcctgctggacatgtcggatcaggtttttcttccggtaaaggcgctgaatgaagccaggagagaaatactggaacaattgaaggaaaaacagacggcaaaatgggagcggcatgaagagatttcccggatgccgtcctgcgggaaggaagacaaggattccggccgcccggaggaaaggaaacagacacggctgtatgcttccgttcataatgctgcgcagctggaagcctgtattcaggaaggggcggaaagaatttatctttctcattcctgtctgtacggcatgacggaagattttctgcggaaggccggaaaagaacggacaggttccgaatggttcctttccctgcccgtaatcctgcgcagagatgacgagggacggcttgcgaaaattgcggatgttttgaaatctggtatttttgacggcgtacagatttcttccccggccgggctgcagtggctggatgaaatcggctggcaggggaaagtggctctggatcaccgggtatatgtatggaacagggaaacctatgatttctgggagaaacaaatagatacctattgtgcgtctcttgagctgaacaggagcgctttgtttgaattaccgggagaaaaacaggaaatccttgtatatgggaatatacccatgatggttactgcaaactgtatcaggaaaactgccggcggctgtctgaaggaaaagggaaaacgggcggtttcggaaaacatggtccggctgctggacaggtacaggacagaattccccgtggagactgactgcggctattgctataatattatctataattctgtcccgatttcccttcacgcttatctgggagaaattgcggaaaagagagtgggcgcggtccggatggatttcctggaggaggatgcggcggctgtccgggaaaggattgctgtattccgcaggcttctgaaccggaagaaggggaatgaggaaccgctgccggatatcaactggaagtttactacaggacattataaaaaaggagccaaatgacaggcatggagcagtatattattgtctattccaagtacataatcactctgtttatgctcttgtattgcgttctggctttttgtcggaccttttctgcaggatggcggggccataagctggataatatacagggcattctcatttttctgattcagtttatcgcttttttgactatctgtgtagaaaaaggggatgtggattatctgtttttctatgccatatcacagatcgtcattttttcctccatgatgatattctccatggcatatacgggtatcaacaggctgctggtaaataatatgtgcctgcttctgggtaccggatttatcatcctgaccaggcttgatatcgctaaagcaggcaaacagctgctgattgcggcggcgtccctggctgtcagtatggtggtgccgctgtttatccgccggatccggttctggaaggatctcacatgggtttatgcaggcgtcggcattacggcgcttggcgtcgtgctgattctgggacaggttactcatggctcaaagctgtccttctctttgggagggattaccttccagccttcggaatttgtaaaaatcctgtttctgttctgcatagccgccatactctgggaggattcctccttaaaaaatatagttatcagcggagcggtggcagccgcccacgtactcatcctcgttctgtcaaaggatctgggaagcgctttgatttttttcgcggcgtatgtattcctggtgttttttgcaacgggtaaaatcagatacctgctggcagggggagctgccgggtgtgcggcctcctatctggccttccttttgttttcccatgttaaggtaagggtgcaggcctggcaggatccctggagcgtaatcgacaaccagggctatcagattacccagtctctttttgccatgtcccggggaagctggttcgggcttggaatagggcaggggactcctaaagatattcccttcgtggaaacggattttatttttgccgccattacggaagaactgggaattgtattcgccatagggattatcctcatatgtatatcctgctttttcatgatccttaaaattgcgggggcttcatcggatccgtttttccgccttgtggtctccggttttggagtaatgtatattttccagattttcttaaccatcggcggaggcaccaaattcatacctctgacaggtgtgacccttcctttgatcagttatggaggaagcagtgttatgacaactcttatcctgttctccgtcattcagggaatctggcttcgggaacgggatacagaggaaaaagaagaacgaaggcggctgaaaacgtcaggatattatgaaccatatgaggatgatgtgccggaagagggagaatttgaagaagaagactgggacgggaatgagtatgaagaagaatacgacgacgaccttgaataaaacagcggcagcgaaaccaaaaaagaaatcgtccggaacaggaaaaagaaagcagaataattcagggaagcaaaggagttccggaaagcaggggtcttcgaaaaagcaaagcccttctatgaaaaaaagggttcaggaggaggatttttctgaggaagaagataaaatctatgatttccggaaaggaaacaggaatctgattggaagcgccgtctttttctgctgcctttttgcaggcctcatcacctatttatgcgtatatgtatcttccaattcagaagcattgtttaacaacagttataacagcaggcagagcgtattggcaacgaaaaataccagagggacaatttattcctccgatggcgatattctggcgcagacggtgaagggcgaggatggaaaagaagtaaggaactatccttatgataatatgttcgcccatatagtaggctattccacaaaggggaaaacaggcctggagagccttgccaattattatttgatcaatacctcggccacagtggcccagcaggcggaaaactcagctgcgggccggaaaaatccgggaaataatctgtataccacgctggatatgaatcttcagcagacggcctataatgccatgggtatttataagggagcgatcgtggtcatggaggtggatacgggaaaaatactggccatggtatccaagcctgattttaatcccaatgaaatcgcagatatctgggacagtgtgacttctgataaagagaattccagtctgctgaacagagcttcccagggagtatatccgcccggttccacctttaaaatcgtgacggcgctggaatatatcaaagaaaatcccgatacgtggagaagctacagctatcaatgcagcggcagtttcacacatggggataataccatccgctgttatcatggcagcaagcatggacaggtcagctttgagcgttcttttgcaaaatcctgtaattcttcttttgccaatataggtatgtccctggataaagcggaattcatagatacgatgcagagcctgctgtttaaccaggagcttcccatcgatattccctattcccaaagccatgtccagctgacacaggacagcgatgatgaggatatgatccagacggttatcggccagggcaagacacagatcacgcccctgcatctgtgtatgatcacttcggctattgccaatgacgggattctcatgcgtccttatgaaatggagcgcattgaaagtgcggatgggaaaataatcaggcagttccaggctgaggaatacggaagtctgatgacatccgaagaagctgccatcctgcaggaattaatggcggacgtagtggaggaaggaaccgcatccaagctttccgggttatcctatacagctgcgggaaagacgggatctgcggaatttaatgcggtaaaagcggactcccatgcatggtttaccggcttcgcacctgcggaacatccggaaatagccataacagtaattatagaaggaatagggtccggcggtgactatgccgtacctattgccaaaagagttttggacgcttattttgatcccgggttttaaggaggccccttctctgtccaaatttatgcttgccttacctaatcttttgggatatacttgaactagtttatcatgtatatgctgtcgcaggacagcattcacacctaacaggaggaattgcaatgatagaagcaactagctgtggcggtgtggttattttccgtgggaaaatattgcttttgtacaagaatttcaagaacaagtatgaaggctgggtattgcccaagggaacggtagaggcaggagaggaatacaaggatacagcgctcagagaggtccttgaagaaagcggtgccagggcatcgattataaagtatatcggaaagagcgagtataccttcaatgtgccggaggatactgtggacaaggaggttcactggtatttaatgatggccgacagttattacagtaaaccacagcgtgaggagtattttgttgactcgggattttacaagtatcatgaagcttaccatctgctgaaatttgcaaatgagaagcagattctggaaaaagcgtaccatgaatatctggaactgaaaaagaaaaatttatggggaaacaaaaagtatttttgagatttcccggtttttgccgggaatctgttcaaaagggaaggtgaggcggaatggacgaatattccatgccgcctttttattcctgcgggcaacgcggcatcaggtgtttgcgcagattttgattaataaaaacggttaaatcggctcatgaatgaataaaacaggcaaaatcaggcaaattttaagataacggttccatatgggctgcctgaggaaagaaagtgataggcacaatgaagttctacagacatctgtatgtcagcgacagtatccgcaatctggaaaaggtaaagtggaagctgcgccataatgccggacagattactatctatattattgcattggcaaaatccgacgaccagctggatatttttcactgttctcttttgcagcagagattttatgacaaaaaggatctttttgtggtaggtcttgcctccggttatggagaagcggttgatatggtagtggctttgacggaaaaggtggcagccgagacgggcggagcggatattaaaaaatatatcctggatcacaggtaacaggagctggacagcctatgggagtagtaataagcattttaaaaatactgggcattatcctgctcgtcatactggccgttctgattctggcccttcttgttgtcctttttgtccctgtcagataccgggcgaagggggaggtgccggcggagggcaacccgcacggcatagtaagggtgacatggcttctgcatcttgccagtttccgtctggaatatgattccggtaaatacgaaaattcttttcactgggatttcaggattctgggaattccattccgtctgaaacaaagggcggcagtacctaaaaagaaaacggaaacggcggaagaagaggcggagacagcggtaaaagaaaaaacggaaggaaaagaaaagccggaaggaaaagcaaacccggaaggaaaagaaaaaccggcggttcccgtacaaaccctgaaggaagagccgcaggtttccggacaaaagcggccggatgaggccggtacggttcccggcggggaatcccggactgaacagataaaggattccggaggacgggaaaaagaaaaagcatcttttttcacccgaatctgtaataaaatccattcctttttcgataatcttaagaaatcatttcagaatatcaggtacacaattacccggctgtgtgataaaataaagcggatcctggataatctggaatattacagggagattttaagccggaaggacagccttctggtgatgggcaaagtaaaaggacaggcaggaaggcttcttaagcatgcgctgcctcagaaaacaaatgtgaattttatcgtgggaacgggtgatccggcatccacggcccagattcttgccatacatggaatattatatcctgtgattggcgagactgttcatatcagtcctgattttgaagaggcccgcctggaaggggattttgatatcaggggaagagtgcggatcgccgtggtgcttgatgtagtgctccgcattatattggataaaaagacctggagatttatcaggcagcttaaaaaggaggaaatgacaaatggcagataataataacggtatcaattcggtgatggagtctcttttgaagggcgctaatgcattgatgtctacgaagacggtggtgggagaggcgacaaaaattgatgataccattattgtcccccttgttgatgtgagttttggcgtaggggccggtgcaagccgcaacggaggcaaagacgggggagccggcgggctttccggaaaaatgacgccgagcgccgtccttcttattaaaaacggacagacaaagctggtgaatatcaagaaccaggacagcgtaaccaagattcttgatatgattccggatctggtagataaatttaccacaaaagaagagcccatgatgagtgacgaggatgccgagaaagcggcgttcccggacgaagatgaagatatcgtggactgagtcttaagcaggaaagggctgcctgatttgtacagcagagtgagtgttgtacgaatcggacagccctttcctgcatatgataatagtaaagccggcaggagtaagcagatgcgtgacatgtggaaattagtgggaattgttgtattcagcatcgcctttggtatgatccttacggttcttatttccaacaggcttgccagcctgattgtggcaattatcctgctgctggtaagctataatgttattttctgtgaaaaataggatagcagaggaaatgttcccgtaaaaagggtacaaaaaaagactgtctgtaaattcataatgaattccggcagtcttatctttgtgttaaccaatacagctgaagataaatcacagaacattctccctgattatactctttcaactctgccggacttcagacagttggtacatacatgtaatttcttggatgcgccgttaaccttgcattttacgcttttaacgtttgaattccagatacgattggatcttctatgggaatggcttacgttgtttccaaaatgagcacccttaccgcaaatatcacattttgccatcttcgcacctcctaaaccagtaaaattttcagaccacaacatgtgtataataccagaaaagtaatagtttggcaagcaaaatttgcatccgggacacaactttatttttggactggctttttacagcaccaggcccgtttatgccgcgacggctgaaattgaaataagacttccattttttttggaaagcggttataataatcttatatttttcggtaagaaagaaggaggtactacatgaagggctcttctatgaacacccatatgggcaatataaccatcgataaagaagttattgcacagtatgcgggtaccgttgctacggaatgcttcggtattgtcggcatgggaatcactgtgaaggacgtagtgaagcttttaagaaaagataatctgtcgaagggaataaccgttacgattaataataataaactgacgctggacttccatgtcattgtttcctacggtgtaagcattctggctgtttcggacaacctgatagataacgtgaagtataaggtggaagcattcaccggaatggaaattgaaaaaatcaacatctttgtagaaggtgtgcgagtgattgattaaggaggactttagttgtgagtttaaatacgatagacgctaaggtatttgcaaagatgttcttagcgggcgccaagaatcttgagagtaaaaaagaatggattaatgaattgaacgtatttccggttcctgacggagatacgggtaccaatatgacccttaccatcatgtctgccgccaaagaagtggctgctatgaaagaacccgacatgatgactcttgcaaaggcaatttcttccggttccctccgcggtgcgagagggaattctggtgttatcctttcccagcttttccgcggatttaccaaagggatccgggaaaatgaagaaattaccattcccattcttgccgccgcaggagaaaaagcggtggaaaccgcttataaagcggtaatgaagcctaaagagggtacgattcttaccgttgcaaagggcgcttccatgaaagcaagggagctggccgatgcaggggaaaccgatatggcttctttcattaaagaagtgattgcgcatgcggaatatgtgctcagccagactcctgaaatgcttcccgtgttaaagcaggcgggcgtggtggattccggcggacagggactgatagaggttctgcacggcgcgtatgatgcttttatgggtaaagagatcgatttttccatcaccgagcccgctcagggagcgtcccgtcaggcatctgtgaatgccagcctggacgttcaggctaatatggaaatcaagttcggttattgcaccgaatttattatcatgctgagcaaaaccttcaatattaaacaggaaatggatttcaaggcttatctggaatcaataggtgattctattgtggtggttgcggatgaagatgtggtcaaggtacatgtacataccaatgaccctggtcttgcaatccagaaggcattgaagtatggtgcactttccaatctgaaaattgacaatatgcggctggagcatcaggagaagcttttcaggatgtcggaagatgctgctgactcaccggatgctgccaaagaggaagaagtacctgctgaacgtaaagagacagggtttatagctgtttccgtgggtgaaggcatcgatgagatcttcaagggcctgggtgtagactatattatagcaggcggacagactatgaatcccagcacggaagacgtggtaaacgctattaaccaggtaaacgcggatacggtttttgttcttcccaacaacaaaaatatcattcttgccgctaaccaggcgaaatacctggtagaggacaagaaagtggtggtaatccccaccaagacaattccccagggaattaccgctgtaatcaactatgttcccgatatgggagctgaagaaaatgaagcggccatgtctgaggaaatcggtcaggtgaagaccggtgaggtcacctatgccgtaagggatacggtgattgacgacaaggaaatcaaacagggcgactatatgggcatcggcgatgccggtatcctgtccgtaggggcggatatcgaaaaggttactttcgatatggtggattccatgatggaggaagaccttgagttaatcagtatttattacggagctgagaccacagaagagtccgcacagaagctgaaggccaggatcgaagaaaaatatccttcctgtgatattgaactgcagtatggcggacagcctatttactattatattatttcggccgaataacatggatattaatacaaatttaactgcgataaaaggaattggagaaaagacggctggtcttttctccaaacttcatatcgggacagtggggcagctgctggaacactatccccgtgattatgaaaggatggaacctgtggtaacggtttccgctttgagtcccgggaaagtttgtgcggtaaaggcatccgttatcggaatgccttccaccaaacgggtacgtaatctgttgatcactgctgttcaggccggggatgcgaccggcctttttcgtattaccttttttggcatgccctatctgaaaaatatgctcaagcccggaatgacctatgttttccggggagtctgccagtatgggactcccctgcggatggagcagcccaggctgttccgggtggaggaatacacggcgcttcagaatacgcttcagccaagatatgcgctcacgcagggcctgaccaataatggtgtgagcaaggctgtgcggaaggcgctggacagtgtcctgtcagaggggaaccggctggaaattcttccggaggaaatcagaaatgaatttcagctgattcccctgggagaagccctggagaaaatacatttcccggagaacacgcaggatctgcttgccgcccgcagaaggctcgccttcgacgaatttctcctgttttttcttgcgctgcgcaaggttaaggaagagaaccagatccggaaggtggaggagcttttggaaaaggtgccggatacggacagacttctcgacagcctgccctaccggcttacaggcgcgcagcagcgtgtctggtcggagatagaagcggatctgcagaaagaaaatgccatgaaccgccttgtccagggggatgtgggcagcggaaaaaccattctggcattcctggctctgctgatgtgtgccgcaaacggcaggcagggctgtctcatggcgcctacggaggtcctggccagacagcattatgaagcattgcttcagatgagcagggagtatgatttgtgcatacgtcctgttttgctcaccggttcccagacagcaaaggaaaagagggaaatttatgcccggattgcggatggggatgcaaatgtggtcataggaacccatgcgctcatccaggaaaaggtgatttaccgtcagctgtctctggtgattacagatgagcagcaccgtttcggagtcagacagagggagcttcttgcggataaggggaagggtacccatgtcctggtcatgagcgctactcctattccaagaacccttgccattgtggtatatggggatctgcacgtatccgtactggatgaaatgcccgcgggacgaaaacccatcaaaaactgtgtggtcaatacctcctatcggcagacggcctattcctttatccgaaaacaggcggaggaaggacatcaggtatatgtgatctgtcctatggtggaggagggggaaatggatggcctggaaaatgtcatggactatacggacaagctgaaggccgttcttcctgacagcatccgtgtggctgcccttcatggaaaaatgaaaccggcagaaaaaaacaatattatggaagctttttcaaataaagaaatcgatgtgctggtttccaccacagtcatcgaggtgggaatcaatgttccgaacgctacggttatgatggttgaaaatgcagaacgtttcggcctggcccagctgcatcagctgcgcggacgggtagggagaggcgacagccagagctactgtatctttatcagcggaaatgataacgaacagacaatgaaacggctgaacatacttaacacctccaacgacggattccatatagcaaacgaagacctgaagcttcgcggtcccggtgatttattcggaatacggcagagcggcctgctggatttcaaggtgggggatatttatcaggactccgatctgcttctcatagcaagcagcctggctgagagaatagccgtacaggatccggacgaaaagctggatcagtacagcctgttatatgagagaatgaaacaggatgggaattccattgactttaagactatctgacggtagaatgattttattgatctttgaagggaaacaaaagaggacagttacaaaaacagacgttcagaaggagcataattatgtcaaaggttgcaattgtaacggacagtaacagcggcatcacccaacagcaggcggaggaactgggtatcagcgtgcttcccatgccttttatgatagaggggaaaacctattttgaagggattagcctgacccaggaggaattttatcagaggctgaaaaccggtgctgccatttccacctcccagccatctccggaaaatattttgcagctgtggaatgagcttctgaaaagctatgatgagatcgtacatattcctatgagcagcggcctgagcggcgcctgccagacggcgcttatgcttgcacaggattatgaaggaaaaatacaggtggtgaataaccagcgtatatccgttacccagcgccgttctgtactggatgccatacatctggcggatcagggaatggacgcagcacaaattaaaaattttctggagaaggataagtacaattccagtatttatattatggtggatactctggtttacttgaaacggggaggaaggatcaccccggcggccgccgctctgggtactatccttaaaatcaagccggtgctgcagatacagggagagaagctggatgcctttgctaaagcgagaacaacggcacagggaaagcagatcatgattaatgccattaaaaacgatttgataaagcgctttgacaggcctttggataacgcggatatgtggctggatgttgcacacacgaataatgatgaagcggcggccgtcttccgggatgaggtgcttcagaccttcccgggaaacgaaagctatatggatcatctttctctgagtgttgcctgccatatcggcccgggggctctggccgttacctgtaccaccaaaaaccattagtaaagcgtacagggttgttctttgcagatattctttcagataaaactataatacatgatatggaaaaggcagaggggaaagttccatatcatgtattttttgccttttcttacccaaacatttgtgctacaatagcacctgggacaggcttccaacctgttttttctttttgttttttattatttataagttcataatgccgccgggcggcagaatgcgaggtttacatgactaaaaacaacagtaattatgacgcttccagtataactgtgctggagggactggaagcggtgcggaaaagacctggtatgtacatcggcagtgtttctaccaagggattgaatcatttgatatatgaaatcgtggataatgcggtggatgagcatctggcaggttactgcgacaggattaaggttacgctggaagccgacggctcggctacggtggatgataacgggagaggtattccggtaggaatgcatgaaaaaggcgtgagcgccgaacgtcttgtattcaccacgctgcatgccggcggtaaatttgacaactcggcctataagacaagcggcggcctgcacggtgtgggttcttccgtagtgaatgccctgtccaccagattgactgtacgggtcaggaatggcgggctgatatatgaagacaggtacgagcaggggattcctgtcgtggagctggagaacggccttcttcctgttgtgggaaagagcagggaaagcggaacctgggtcaatttccttccggatgacaccatattcgaaaagacccgttttaaagaagatgaggtaaagagccgtcttcatgaaaccgcatatctgaatccgcagttgaccattgtctttgaagataagcgaagagataccccggaaaccattgaattccatgaaccggacgggattgtcggctttatcaaggacctgaataaatccaaggaaacagtgagcgacgtcatatattttaacggtgaaagcgaaggcatatccgtggaagtggctctgcagtatgtgaatgaattccatgaaaacgtcctgggcttctgcaataatatttacaatgcggagggcgggacccatctcaccggtttcaagacgatgtttaccagtgttatcaattcctactccagagaattgaatatcctgaaggaaaaggatgccaactttaccggtgcggatgtacgcaacggcatgactgccgtggtttccatcaagcatccggatccccgtttcgaggggcagaccaaaaccaagctggataaccaggatgcttccaaggtggtaagcaaggtgacgggagaagagatcacccgttattttgaccggaatctggaaaatctgaagaatattatcggctgtgcggaaaaagcggcaaagatccgtaaaacagaagaaaaagccaagaccaatatgctgacaaagcagaaattttcctttgattccaacggaaagctggcaaactgtgaatcaagggacgcctccaggtgcgagattttcattgtggagggagattccgcgggcggcagtgcaaagacggcaagggatcgttcctatcaggccatcctgcctatccggggtaaaatcctgaacgtggaaaaggccagcattgacaaggtgctcgccaatgcggaaataaaaacgatgataaacgctttcggctgcggtttttccgaaggctacggcaatgactttgatattacaaagctgcgttatgataaaattattatcatggcggatgcggatgtggacggcgcacatatatccacgcttcttctcactcttttttaccgctttatgccggaactgatatttgagggacacgtatatatagccatgccgcctctttataaagccatgccctccaagggaaatgaagaatacttatatgacgacaaagcgctggagcgttacaggaaacgccataaaggcccgttcaccctgcagcgttataagggactcggggaaatggatgcccagcagctttgggaaacaacgctgaatccggaaacccgaatgctcaagcaggtggaaatagaagatgccagaatggcctcggaagtcacggaaatgctgatgggcacggatgtccctcccagaaaagcatttatttacgaatacgccccggatgcggagcttgatatttaacaggattgtaatggcatggaacgtcttgtctccatgtaaacaggaaaggatgcaatagaaattggaagaaaagattataaaaacagaatattctgaggtcatgcagaaatcctttatcgattatgccatgagcgttatcgtggccagggcccttcctgatgtgagggacggcctgaagccggtgcagcgcagaaccctgtatgatatgcatgagctgggaatacgttatgacaggccttacaggaagagcgcgcgtatcgtgggtgataccatgggtaaataccatccccacggggacagctccatctatgacgcgctggtggtgatgtcccaggatttcaaaaaagggcttcccatgatagacggacatggaaacttcggcaatatcgaaggagacggggctgcggccatgcgttatacggaggcgcgcctggaacaggtcacccaggaggcatttctggcggatctggacaaggatgtggtggacttcattcccaactttgatgaaacggaaaaggaacccagtgtccttccggtcaagttccccaacctgctggtaaatggttcggagggtattgcggtaggtatggctaccagcacgccgccccataacctgtcggaggttatcgatgcgaccaaagcctatatgaataacgaagacatcaccaccaaagagctgatgcgttatatacaggggcctgatttccccacgggcggaattgtgaccaataaggacgatctgctctccatttatgaaacaggagccgggaaaatcaaaatccgcggcaaggtggatgtggaaaaaggaaagggcggcaaggtcaatgttgtcatttccgagatcccttataccatgatcggctcctatatcgggaagttcctttccgatgtcgcgtctcttgcggaaacaaagaaaacgcaggatatcagcgatatttccaaccagtcctccaaagagggtatccgtattgtcattgagcttcgcaaggatgcggatgtggacaattttattaacatgctgtataagaagaccaggctggaggacacgttcggcgtgaatatgctcgccatcgtggacggcaggcctgaaactctgggactgaaggaaatcataaaagccagcgtggatttccagtatgaaacgaccaccaggaaatatgagaacctcctcgccaaggaaaacagcaagagagagatacaggaaggcctgataaaagcctgcaatgtcatcgatttgatcattgagatcctccgcggctccaaagaccgggctatggcgaaggcctgcctggtggaaggaaagacggacgggatccgttttaaatccaaagaatcagggatcatggcccagcagctcaggttttcagaaaaccaggccaatgccattctggaaatgcgtctgtataagctgatcggcctggaactggaagccctcatcaaggagcatgaggagacggttgccaatatataccggtatgaagatattctttcgagaaaagattccatggcccaggttattatgaacgagctggattccataaagaaaaaattcggaagaaaacgcagaaccgtaatcgataactgcggggaagtcgtttacgaggaaaagaagctggaggaaatggatgtcgttttcctcatggatcggttcggctatgcgaagacgattgatctgtcggcctatgaaagaaataaggaagcggcggatgccgagaataaattcgtattccagtgcaagaatacgggaagaatatgtatgtttaccaatatgggccagctgtataccgtaaaggtacaggatctgcccttcgggaagttcagggataagggaattcctatagataacgtgagcaatttcaattcctcccaggaggaactgcttctggtaacaagccagtccgagctgaatctgtaccgtgtgattttcgcaacccggatgggaatgctgaagatcgtggacggaggggagtttgacgtggccaagaggacggttgctgccacgaagctgcaggaaggcgattcggtagtaagcgttgttgtaatgaaggagcagaaaaacataattctgcagtccagggcgggttatttccttcggtttgccgtagaagaaataccagaaaagaaaaaaggcgccatcggcgtccggggaatgcgtctgagtgaaggagactctattgaagcggtttactacaccaggctttcggatgaaacatctattccttataagagcagggagcttgtactgaatcagataaaggcagcaaaaagggacggcaagggaataaaggtgcgggcttaaaaaacagggcggctgaaaacagccgccttttgcactttttttcacgggtgatttataaatttataaaacatttccatatgggattgccttttttttcacaagcaattataatgtgaaacagaatccgaaatgctgtgagatatagcggttcggagaaaacagatacagtcaggagatattatgagagttattgcaggcgaggcgcggagccttccgttaaaaacaccggaagggcaggatacaaggcccaccacggatcgtataaaggaaacattattcaatatccttcagggggacattcccggcagcattttcgtggatttatgcagcggaagcgggggcataggaatagaagctatcagccgcggggctaaaagggcttattttgccgagaatgcggttaaagcggcaaaatgtatacaggacaacctgtcctttgccaaatttaccgacagggcggttctgctgaagcaggatgtggtatccgctctcggaggcatccacgaaaaagaagtggacgtgatttttatggatcccccttatcaggcgggattggaggagccggttctttccgcgctttcccgtgcttcttatgtgacggaggatacgcttattattatagaagcggagctgaataaggatttctcctttacgcaggattatggctttgaggttatcagagaaaagaaatacaagacaaataagcatgttttcatgaaaaggcagaatgcggagtaaattacagaggattttaatcacttacgcgcaaaaacacgcagatgggagcaattatgaaagtagcgatttatcccggaagttttgatccggttaccttcggacatcttgatgtaataagacgggctgcgtcgatgtttgacgaattaacagtcagtgtgttgaacaatacccagaagactccgttgttttctgtggaagaacgtgttaaaatactagaagaagccacaaaagagctgcccaatgtaaaggtggactctttttcgggattgttaatcaattatgccagggaaaaggacgtgcatattgctatccgcggtctgcgtgccattacggatttcgaatatgaactgcagattgcccagacgaaccgcaagctttccaatggtgagctggatactattttccttaccaccagtctggagtacgcttatttaagctcctccagcgtaaaggaaatcgcggaatttcatggggatatttctcaatgtgtacctgattttgtggcaaagcttgtatatgaaaaatatggacatgaatgtgagcagtaggcctttataccggcatattgcttatgaaggagaaaaggatgagcagcagaatcgaacaactaattgacgaaatcgaagaatatatcgacagctgtaaatatcagcccctttctaacagcaaaattattgtgaataaggaagagctggaagagctgcttcgggaacttcgtatgaaaacccccgatgaaatcaaacgttaccagaaaattatcaataataaggaagccattctgaatgatgcccgtgaaaaagcggaggcactgatcaatgaggctaccgtacataccagtgagctgattaatgaacatgagatcatgcagcaggcatatgcccaggcgaatgaggttgtttctcttgcaacacagcaggcccaggaaattcttgacagcgccacggtggaggccaacagtgtaaaagcgtccgccatccagtatacggatgatattcttgccaatctggagagtattatcggacatggaatcgatattgccagtgagcattacggtcagtttatcaatgagctgaatcagtgtttaggggtggtacagtcgaatcgtatggagcttcgtcccgacgatgaggatgataccgcgtccctgcctaatcttggcgacatggatgtttccggggcagataccggagatttgaatctggatctgatgtagtgcacgctttgaaaaaatatatggataaagaattcatgaagggcgtcttcgggaagaagacgtctttttttgtctggaagcagggcctgttttatgttatgataaaaagaccggttgttacgaaacggaaaaaggacaatacaaaagaaaataaaggcaggtatcggaagtgaagaaaaagataacaatcataacatttttactggctgtatgcgcactcgcatggatgcccggaatacaggcacaggctaaggaaccggttatcgtggttattgatcccggacacggcggggaagaaaacaggggcggggaagtgcttcctcattatgtggagaaaaatctgacgctccaggtggcgcaggccatgaagcagacactggaacagtttgaaggggtggaggtatatctcacacggacaacggatcaggagctgtctttagagcagagggcgcagatagccaaagcgtatcatgcggatttcctgttctcccttcattttaatatgtccgcagagcataatctttacggaacagaagtctggacctcagccttcggaaaatattatacggcaggacagaccttcggccggcttcagctggcggaaatgtcccagtacggcctttacaataaaggcgttaaaacaaggctgaacagccgcggaaccgattattacggagttatccgtgcctcccgggcactggatcttccgtgtgttattattgagcattgctacatggatcaccccattgacagcctccaggcgaatacgccgcagaagctggttaacttcggggtgagtgatgccatagcagtggccaaatatttccatctgaaatcagcctctctcggactggatttcagcaattaccagtacagtaaggttcctgctcccgcaggcggcgttgccgtaccggattccacaccgccggagaatgtaaatatggtgataaccaacacggatctgaatacgggaaaagtggatatatccctgagcgcatcagatcctcagtccggcatgctgtattacagctacagtattgacggcggcattacctggtccgtgctgactccctgggcgggcggaaatacgatacaattttccataacagttcccggaggcagccagcccatcattatgtgccgggcttataatggctatgattatcatacggacagtaattttgccgtgccgggagtttttgccgccaggtaaatcccggaagaagaatgcggcggttaaaaaacatacaggaatgtataatatacaaaagccagcatagtctgcactattttatggcccacatagttcttcagggagagatccgtctcctgaatcatgctgtaggtctgggctatacaggacaggccgccgaaaggcagaagcacatagccccagaaggccatggaagcgggcaggcgtgacaggccgctggtgatctccagaatacagccgatgatatcctgcagtgccgtcagtttggatggaagcaggatttcgggaatcaggttgagcaggttaaagagtatcatatagcctccgagagaggcgatggcacacagggaggatacgatggaattctgcatttccgcaaaaagggaagggcctccgggcagtcttttttgttctgcggcggcaggggcttctgcagcatgcaggctgtgttttttgacggataagtgcattttatttattccgctttctccgatccgtgcgggtcttgggatatcgcggtaggaagtatagcgaaggaacaaaccgtaaagaagaggcagcagatacattcctgcaagaaaagcccaggggtgttccaccggaaacagatgaaagacaaagctggtgaaataaatagggccgatattattgcagaaggccagcatcagttcggcttcccttcgggaaagctttcctctctggtagctttccgccgtcacacgggcacccatgggaaaaccgcacaggaaaccgataaccagtacataaatgcaggaatcggataactggaatatgggcctgaacagcggggaaaacaaatgggcaaagctgtcggacaggttcatacggataaggatgccggagagtatcataaagggaagaagcgttgggatcattttctggaaccacaggttcaggcctgtcagggaaagtgccagcgctttttcattttccaggagcatcgctgtggtaaggaaggcaaacaggcagagaaaaagcacctttttcagatagtctatacgttctttccttttttggggggagtaggcactcggggtgtaacggcgcatcggacagcctcctttggcaactgtaaccttgtaagaatgaagggaatcatgtatacttgacagaggtatatttgctgcttattattaaaagctatgtgcttcagccgtccggaatgactgctgaatgaattttttgtttatagatgcttcggaagggaaacagaatgcttcgtttggataaatttttatgtgaaatgaaaaccggaacaaggagccaggttaaggcgcttgtaaaaaagggggctgtgacggtcaacgggataacagcaaaaagcccggaacagaaaattgatgaaaattctgattgtatctgtgtaaacggcagtgaggtttcctatcggaaatatgtgtatttcatgctccataagcctgccggatatgtcagcgcaacccgggataatcatgacaaaacagttctggatctgatgcgggcacagaaaaacccgctgcttgacagggaactttttccggtgggacgcctggataaggatacggaggggctgcttcttataacggatgacggggaactggcccacaggctgctgtctccgtccaggcatgtgcctaaaacctattatgtggaaattgacggctgcctgtcggaagatcagcagatgagcctgcggcagggcgtggatatcggtgagaagcagcggcagacggacggtacgcaggaatatattccggaaaagacccgtccggccgggcttacgcaggcggctcaggatgaattctgcagtgaccgggctgaatccgcctggcttcttaccattacggaggggaaattccatcaggtcaagcgtatgatgcaggctgtgggaaggaatgtggtttatttaaagcgtctcagtatgggggagcttcggctggatgagaagcttgccaggggagaattccgcgaacttacgaaggatgaggctgagaagcttatgtaacttgaaggtacggaacagctacaggctttttatagaagggaagcataagccatgatgatggatggaatagaagcggttatatttgatctggacggttccctcgtggattccatgtggatatggaaggatattgatatcgaatatctggggcgttttgggctggagcctcctgccgggctgcagagtgagattgaggggatgagtttctcggaaacggccggttattttaaagaacgattccggctgcctgattctgtggagaagataaaggaagactggaaccggatggcttgggacaagtatatgagccaggtcccgctgaaagaaggggtcagggaatatctgtcatggtgcagcgggaggaatatcaagctgggaatcgcgacaagcaattcccgggaactggtaacaagcatagccaaagtgcaccggctggaacgttatttccaatgtattatgaccggctgtgatgtgggccgcggaaaaccggctccggatatttatcttgcggtggcaaagcagctgcggacagatccgaaggcatgcctggtctttgaagatatcattcccggcattcaggcgggtaaggctgcggggatgaaggtctgcgccgtggaggatgcctattcgctggatcagacagaagagaaaaaaacgcttgccgattattatatcaggcattttgcagaagttctgtattaattataaggatggatttatcaatgacaactaccggatttttaccgataacaagagaagagatggaagacagggggatcacgcagccggattttgtgtatgtgaccggcgacgcctatgtggatcacccttcctttggacatgccataatcacccgcattctggaggcgcacggctacagtgtctgtatcatttcccagccggactggaaggatgagaagagcatcagcattttcgggtgccccaggctgggattcctggtttcctccggaaacatggattccatggttaatcattattttgtatcccggaaacgccggccctccgacgcctatacgccgggaggggaagccgggaagaggcccgatcatgccactgtggtctactgcaatctgatccgccgggtgtaccggactgtacccgtcattatcggcggtatcgaagcaagcctgcgacgtatggcccattatgattactggagtgattcctttaaacgctccatccttctggacagccaggcggatctgatttcttatggtatgggcgaaaaatccattgtggagattgccgacgccctgaacagcggaatagaagtgaaggatatttcctttattccgggaacggtttacaagacaaaggatatttcaggtatttacgacggaatcatcctgccttcttatgaagacatgaaggaagataagaaaaaatacgcggaaagctttatggtacagtattccaatacggatccttttaacggaaaggcgttactggaaggatatccgggaggccagtatgtggtacagaaccctccttcggcgcctctttccacagaagaaatggatgccgtatatgccctgccttatatgcgcacctatcatccgtcttatgaagagaagggcggcgttcctgcgatcagtgagattaagttttccctgatcagcaaccggggatgcttcggcggctgtaatttctgtgcgctgactttccatcaggggcgtacggtgcaggtcagaagccatgaatccattctggaggaggcggagctgatcataaaggatccggatttcaagggatacatccacgatgtgggcggccctaccgccaacttccgggctccctcctgtgaaaagcagctgactcagggagtgtgtaagaaccggcagtgtcttttcccgaagccctgtcctaacctgaaggcggatcatcaggattatctggaactgctgcgcagtctgcgggctcttcccggggtgaagaaggtttttatccgctcaggtatccgctttgactatctgctggctgataaggatgatacttttttcagggaactggtaaattaccatatcagcggacagctgaaggtggctcctgagcatatttccgatgcggttctcaccagaatgggcaaaccggaaaatgcggtatatgaacgtttccgcaaaaaatataaaaaattaaacgatgaactggggaaaaatcagtttctcgttccctatctgatgtcctcccatccgggctccactttgaaggaagcggtggaactggcggaatatctccgggatctgggatatatgccggaacaggtacaggacttttatcccacgccttccacggtttccacggtaatgtattatacgggaatcgatcccagggacggcagaccggtatatatctgcaggaatcctcacgataaggcaatgcagagggcattgatccaataccggaatcccaagaattatgaccttgtgcttgaggcattgacgaaggcgggaagaaccgatctgattgggtttgataaaaaatgtctgatcaggccccgaaaacagacggataaccggggcaccgccgctgccggaaacggaaaagggtatgacagggcaaaggggaaaacggaaggcagaccggctaagaagaagactatccgcaacgttcacaaaaagaaatagaggtgtaaaatggttaaccggctgtttgggatctgctatcagctgatgaaacgggaaaagatccccgcaagggaactggcagaaagatatgaagtatccgtacgcaccatttacagggatgtggaaatgctcagtatggcaggagtccctgtttttgccagtaagggaagaggcggcggcatttccctgatggagcattgcgtcattgacaaaatgttcgttaatgaggacgaaaaggcacagatcctcgccgcgctggaaagcctcagggaaacagccccttcggataacacggagcttttgcagaagttaggagactttttccagacatcgggcagcaattgggtatctattgatttttctgactggagcgggaggcaggaaatgcttttttccctgctgaaaaaggctattctgcagtcccgtgtgattgcatttgactattacagcgctgacgggaagatggaacaccgcattgcggaacccattcagctgtgttttaagagtcataactggtatctgcgcgcatggtgcagaaacagacaggatatgagaaccttcaaggtgcttcggattaagcggcctgagattcttgatgaatccttttcttcccggcgcatctgcggaaggaacgcagagcctgcccctgcggagcaggaagataaaaagatatcggcctgtccggagttaaccactgttattctggaaattgaaggctctcaggcctaccgtatttatgacagcttcggggaagaggaaattttccccgaagaaaacggtgattttctcataaggacagcctacagtatcgatgattgggtgtatggggtgattctgtcctactgcccttatattaaggtgcatgaacctgtctggctcagggagaagctgcatcatattcttcagaaatcttcggaaaaaatatgacatacagttgtcagcttttgtttgctacaataggaagaaacgggaggacatgcatatgcttgagataccggaaagccatgtgctggcacagcaattaaatgaaaccattcaggggaaaatcatttcctttgtccgggcagggcacactccccattcctttacctggtattcggataacccggaaggctatgacgacctgctggccggaaaacggatcggcatcagcagggggatagggggaatgctggaaacagaagcggaggactgccgtatcctgttaggggacggagtctcccccaaatatcacgaagacagtaaaaaggcccctgcaaggcaccagctctatctggaatttgatgacaatacggcaataacctgtaccgttcagatgtatggaggcatttgggcgttcccggaagggaccaacgacagcccctattatgccgctgcctgtgaaaagccatctccgctgacagaagctttcgactacccgtattttttatccttaagaaaagaagaggacagcaggctttccgccaaggcctatctggctacaaaacagcggatcccggggctgggaaacggtaccctgcaggatactctttttacctgtgggatacatcccaaacgcaaaatggccgatgtgaatgaagaagaataccataagatgtacgacgcggtaaagtcggttctccgggaaatggcggacaagggaggacgggatacggaaaaagatctgtttggccaaaagggcggatattccactatattaagcaaaaatacactctggtcgccctgtccccgctgcggttatgagctccgcaaagggaattatctgggcggaactatttattactgtgaacactgccagaaataaaatttgtaaaaacgtttaaaaccttcagcttacatgctacaattgggatatgtaagccggaggtttttgtatgaaaaggataaggaggtgcttatggaagaaaaaatgcctgcagcaggaaaacgaaagtatatggaagtactgaaagaaaaatttgttgcctttaaagggaatatgaaaaatacatttgtctgtttccctgtcacacaggggagtatctggctgtttaccctgttgtttgttcttttgatcaatataaatgattcctcagttatggattttttgggaaggatcatgttctttttggttttctatggcaccggcagctttttcacggaagccctgtaccagaaatgtaggaagctatggctgcgcattgtcctttatatcgcgtttgttattccggcagttctttttgcatggctggttacgctggattacgacagtatgtttttggcctgggagtatgatacgattgaattctatcttccccggtatatagcctgttatgaactggttctttttacgctggcagtttatttctgttttcggaaggctggcttttccctggaagaatatttggcacgtttttttgcatgggcggtccgtgtcagtattttatattttgtccttatcataggagtaggcctgatcatgggaatactcgtggaattatttgatgtggattatgatattttcattcaggcacaggtgctcctgtttggtattttttatgtatcctctctgcttcgcggcgtactgccgaagacaggggatgacggaccttttgcggaggtcctgataaaatatgtgatgacgggccttgtgatcagcgcgtttgccataatatatgtgtatatcctgaaaattttaattttccgggatatgccgtccaattcgatcttccgtatcctgacagggctgtttattgcgggacttcccatatggaccatgaatgccttttatacccagcataatccgctcctgaaaatcagcagattgctgccatacctgtttgcgcctctggtcctgcttcaggcatattccatagggatacgtatttacgaaaatggaatcacgcccatgcggtatgtctgtatcatgctgcttgtattcgaaattctgtacataacactttattatttcagaagacagtcggctggcattctgttccttgttttcgccggtcttgtttttgcagcctgctgtgtgccgggtatcaatatgttcagtatttcttacaggaaccagaagagcgcgctgcagaaggttttgaatgcggaaacgctgtcagagctgtcgcagcgggaactggacagagcgtccggcgcttactggtatctttatgatgacctgccggggagcgcatatctggaggaactgacagatgagcaagagaaaaagctggaagaaatcaggtcggagagatattcggattatcatgatacctacaatttttatcattcagaggagattacggtcctggatgtttccgattaccggtattgctatccggtgaatgagtatgccagatatgatacggaagaagaattactgacagaatattcttttacatatggggataataaaacaataaccattcatttaaaggagtacctggatggatatcttgatacggaaaaatattcggaagaaagctatgagtatttccgttcccacagggaaatcatctgtaatgatgactgccgtctgtatctggagtatctttcctttaattatgactatgtgacagaagaatatacgaatgtatccctgaggggatatcttctggaaaaataagagaggagcatcagaaaatgaatgttgtgataataaccggagcttcttccggcataggaagagaatttgccctgcagctggatgcaggcctgtatactgtggatgaattctggctgatagccagaagggaggagcgcctggaagaactggccgcccggctggatcatatggcaaaagtaattcctatggaccttaccagtgatgccgatatggatcatttccgtaagcttctgaaaaaagaacggcccgttatccgtatgctcataaacagttcaggctatggcatgatgggaaacttcaacaggctgggaagacaggaacagcttggtatgctggacataaactgcagggcgctgacggatatgacctatgcatgcattccctatatgaaaagaaaaagccgtattatcatgatggcgagcagcgcggcatttcttccgcagccggggtttgctgtctatgcggccagcaaagcttatgtcctcagcctgtcaagggctctgcgtgaggagcttggcccggaggaaatttatgtgactgccgtctgcccggggcctgtcaggaccgaattctttgagaaggcggagaagcacgaggataccctggctatcaaaaagtatagtatggtggaggcggaggatgtggttcgttcggcgctgaccgcttcggccaggaatcaggggatgtctgtgtatagtccgctgataaaggggctgcatctgctcacgaaggtggttcctcatggggtgctgctgggggttgtgcagaagatgaagtagtgggggagacgtataaacgcatccgccccatgttccctctgctgtctcatatggtttcctcctctccgccgctgccgggggtatgtttgcggggccagcctcaaaaatggggtgtttctaaatgttccgttccgccgggattatgccaacgcggcagaactcctcgcgggaagcggcccccttggggcgctttccgttcgtcagacaagccgctaagggcggcataatcccggcggaacggagcattaagaaacatcaccattttttcccatggccccgtaaacatacccccggcagcggcggagaggaggaagccatatgagacagggagggaacatggggcggatgcgtttatactggaggttacgaatgaagggaaaaagattaattatataagaaatttggggaaggtggggaattggttttggggtgagatgatgcgttttttgttagggtgtattgacaggggggctttaacgtggtaggatgagaaaaagttttccgggggaaccggaagggtttaagagggaaaagatgaaatgttgtttggcgtccggcggatgtaaggtccgtgcatatgtgcatagctatttttatggaaggcgtatttgcttgtagccgtgtgagggagttctttttagggaagctcttttcatgcatagtatacaagccggtaggtcttatgtgtctatgcagaaatgttgggagctgataatgtttgtttatattttctttgcttctgttccgcatcagacatatatttgtcgggtgcggttttttgtttttcccggaaggaggagagagagtatgattggtgtaaaaggcgggccggtacagctggtattggcacagaggagtgatgcgcagctgattcatgggctgaaaagggaggcgtttatgccgctttatgaaatctatcgggatgatgagaccagtccggttatggatacggtggataaggtggtgtgtcagctggcgcaggaggatacggattactggctgatagtttatgagggaaggatggtcggcggggtgagggttgtgcgtaagaaggatgcaaatctgatttcacctatgtttgttttgccggaggagcagaataaggggattggctccgctgtgttggagcagctttttcagatgtatccggaaacgttttgctggaggcttgttacgattcaggaggaggagaggaattgtcatctttatgaaaagatggggttctgtaatactttgtctgccaggaaggtgtcggggaatatgactttgattgggtatgaaaggttttttaaggagagcagcggggagggatgattgtggaaggagacgggaaagcaaatcaggaacaggcacttctggatttctcttacataatgtgttaaactgttacaagaattgaaaacaacggaggaattgcctgtcatgcatcgaataaaaaaaggacagtacggctatatcaaaagtcagaggaaaatggaaattattaaaacggtttccctgtttttgctttccctggcgatttatctttgtggttactggactaccggaacgaacaaaaatcttctgaccatagtcgctattttgggatgtctgcccgcaagtaaatgtgcggtgaatatgattatgtttatcagggcgaagggctgcagtgaggagctgtaccagaaaataaatccccatacaggggagctggcttctctgtatgacagtgtactcacaagctatgattcaacctttgaaatcccccacatggttttccgggggaataacctggttggtatcgctgttaatcctaaatgtaaaaccgcagcctgtgaaaagcatctgcagagtatgtgttcacaaaataatatcaaggatgtaaatatcaaaatttttcaggatattcccaaatatctgaaccggcttgatcagctcggggagctttcctgtgaggatactcagacggaggccgtactcgctctggtaaaggcaatatctctttaaggagaccccatgaaagaagtaacagttggatcaaatgaagccggacagcgtctggataaatttcttaaaaaatatttaaaggaagctggcagcggcttcctttataaaatgctgcgtaaaaaaaatattaccctgaacggggcgaaagcggatggaagtgaaaagcttattcggggggacagggtttgtttttttctctctgaggagacgctggaaaaattccgcggcccggcgccggatatcgcttcagggaacttggggaatcagaaggggaataagcctgagagggcggggaagaaagcttctgtgccccgggtgccggtcatttatgaagatgacaatattctgcttctgaataagccggcagggcttttgtcacagaaagcctcgcctgaagattattctctgaatgagtggctgattgattacctgcttgaacagggagagattacccgggaaggtctgcgcaccttccgtccttcggtctgcaaccgtctggatcggaataccagcggccttgttgtctgcggcaagacgctggcgggaagccagaagatgagtgaactgctgagggaaaggaatgtacataaattctacaggctttttgccgcaggaagggcggagctggacggggttacggatgcatggctgcgtaaggatgagaaaaacaatcaggtggaaatccttccggctccgccttccgacagcagcagggcgtttcatattgtaaccggctgtcatcctctggcttattatgaaggctatacctatctggaggtggagctgtttacgggaaagagccatcagatacgcgcccatctggccgctttggggcatccgctgatcggggacggaaaatacggtgacaaacatatcaatgaccgtttccgcagacagagaatccgctcccagatgcttcatgcttatcggatagaatttccggagatggacggcctctttgccgggctgagcggcagagtgtttaccgcgccggagccggaatcctttcttctgctgaagaaagaaggaaattaaggacatcgcggaggataaaaatggcaacatggaattcgagggggctcaggggttcgacactggaggatttggtaaaccgtaccaatgaaagatatcaggaaaacgggctggcgcttatacagaaaatcccgacgcctataacccctataaaaatagataaggatgagcggcacattacgctggcctattttgaccagaaaagcacggttgactatattggcgtggtacagggccttcccgtctgttttgatgccaaggaatgcgcggcggatacctttgctcttgccaatattcatgaacatcaggtttcttttatggaagcttttgaaaagcagggaggaattgctttcttccttattttcttttcacacagaaatgaattttattatcttccttatgcccacctgcgttatttctgggatcgggccagggaagggggaaggaagagtttccggcatgacgaactgaacccggaatatttccttccgagaaaacaggggattctggttccctatctggacatgcttcagaaggatctggaggaaagagaggaatgaaatgaaaagtccggtaactactttatgctatattgagcaggatgataaatatctgatgcttcaccgtataaaaaagaaaaatgatctcaacgaagataaatgggtggggatcggaggccatgcggaagagggggaaagcccggaagattgtcttctgagggaagctatggaggaaaccggcctgagccttacctcctaccaattccgcgggctggtaacttttgtgtccgataaatggggaaccgagtatatgtgtctttatacggcggacggctttgaaggggaaatgattgactgtaatgaaggctgtctggaatggatagccaaatcgaaaatccctgaactgaatctgtggacaggcgatcttatttttttccgccttctggaagaaaaggttccttttttctctcttaagctgcgctatgaaggagaccttctggctgaatggcagctgaatggaaaggacatgacggggactgtcctgtctgatgaaaagtggaaggaaatacttgacagtctgaggcaggtctagtatagtattgatagtttgccgtgctaataaggtagtcaattatcacgttaatgcgataaagtaaaaattatttcaaaccaaaaggagagaggctgcaatgagtaaaccattagtacataccccggaaggtgtccgtgacatttatggcgaggaatatttaagaaagctgatggtggaagagaagctgcaccattccctgcgttcctatggttatcaggatattcagacacctacctttgagttctttgacgtattcagccgggaaattggcaccacgccgtcaagggagctgtataagttttttgacaaagagggtaatacgcttgtcctccggccggatttcacgccttccatggctagatgcgccgccaaatattttatggatgagactcttcctatccgtttttcttatctggggaatacatttacgaatacctccaatcttcagggaaagctgaaggaggtcacccaactgggggccgagctgattcaggagccttccgtggaagcggacggcgaaatgatagctcttatggtggaagcgctgaaatcctccggactggaggacttccaggtgagcatcgggcaggtggagtattttaaagggatctgctcccaggcggggctggatgaggaaacggaagacgaactccgggattacatttccagcaaaaactttttcggcgtccaggagctgctggagcggaaagccatacgccgggattattgtgaaattcttctgaaagtaaacgatcttttcggttctgcggaggcgctgcagagggctaaagagcttgtgagcaatgagcgttcccttcaggcggttgaacggcttgaggaattgtaccgggtcctgtgtgaatatggggtggaacgttatgtttcctttgacctggggcttttgagcaagtaccattattataccggcgtgatcttcaaagcctacacctatggagtcggggatgcggttgccaagggcgggcgttatgacaatcttctgaagtacttcggaaaggaagctcccgccatcggctttgttatcgtggtggatgaccttctggaggctctggccagacagaaaaaagtcccccggctccgtgcggacggcgtattgattatatatgaagaaggaagattccgtgatgcgcttaaaaaggcaaaagagctgagggtgcagcagattcctgccgaactgatcccggcgatttccggggcagattcctccgataccggttcttttgataaaaatgttaaaatttaccgggagaaatccaaaaaccatatgcagaaggccttctattacatgcccgcggaaggcggctgtatggaagaacttctggaccggaattaagagaaaggaatcggaaaaccatggatgaaaaaagatatttaacctttgcccttgccaagggccggcttgcaaataaaacgctggagcttttggaggaagtgggcattacctgcgaagaaatgaaggataaatcctcacggaaactgatttttgtcaatgaggagcttaagctgaagttctttctctccaaagggccggatgttcccacctatgtggagtatggcgccgcggatatcggcgttgtgggcaaggatactctgctggaagaaggaaggcgtgtatacgaggtgttggatctgggcttcggtaaatgccgtatgtgtgtctgcggcccggcagagtccaaagaactgctgaagcatcatgagatgatccgtgtggcgagcaagtatccgaacatagcgaaagattatttttataataaaaagcatcagacagtggacatcatcaaactgaacggttcggtggaactggggccgattgtcggcctgtccgatgtaatcgtggatatcgtggaaaccggaagcactctccgcgaaaatgggctggaggttctggaagaggtgtgtcccctttccgcaaggatgattgtgaaccaggtgagtatgcagatgcagccggaacgtatcaaaggattgatcaatcaattgaaggaaaagctgtaggaagggagccagactatgaggacattaaaattatcggagaatacaaaaaaggacttgctgaatgatcttctgaaaagaagccctaataactacggacaatatgaaacggttgtggcggatattattgcccaggtgagagaaaaaggagacgaggctgtttttgcccttaccagtaaatttgatcattgtgagatcacccctgatactctgaaggtaacaaaagaagagatagaggaagcttatgcgcaggcagggaatgaattcgtggaagtcatgcaaaagtctgcggaaaatatacgtctttttcatgagaagcagctgcgcagcagctggtttgatcccaggccggatggtacgattctgggtatgaaaatgcttcccattgccacggccggagtgtatgtgcccggcggcaaagcggcttatccctccagcgtgctgatgaatgtaattcctgccaaagtggctggtgttgagcgcattatcatgctcacgcctcccggcgccgacgggaaagtgaatcccggaacgctggcggctgccaatattgcgggagtggatgaaatctataaggcggggggcgcccaggcaatcgctgccatggccttcggtacggaaagcatccccaaggtggataaaatcacaggccccggcaacatttttgtggcccttgccaaaaaggcctgtttcggttatgtgagcattgattccattgcaggccccagcgaaattctggtcattgcggatgaaacggcaaatccccgttatgtggcagcggatcttctttcccaggcggagcatgacgaactcgccagcgcgatcctcattaccaccagtgagagcacagcggcgaaggtatcggaagaaatagacggatttctgtcttccttaagccgcagtgataccatccggaaatcgcttgataattatggatacatattgattgcagacagccttgacagcgccatagatacagcgaacgaaatcgcttccgagcatctggaaatccttacgaaggatccttattccgttatgacaaagatacgcaatgcgggagccattttcctgggagaatattccagcgaacctctgggcgattattttgccggtcccaatcatgtgcttcctactaacggcaccgccaaatttttctcgcctctgaatgtagatgattttatgaaaaaaaccagtattatttcctattccagggaggctctggagaaggttcataaggatattgaactgtttgccgaaagggaaggcttgacggctcatgcaaattcgattaaagtaagatttgaatagtgattttaaggagggcaggccaatggaacaggagacgggcggatgccgccaggcatccataaccagaacgaccaaagagacggatatcactgttaccttgaagctggacggtaccggaaaaagtgacatccgcacgggaatcggattttttgaccatatgctggagggcttcgcacggcatggcctgtttgatctgaccgtacaggttaaaggcgatctgcaggtggacggccatcataccgtagaagacaccgggattgtcctggggcaggcaatcgctcaggcaattggtgataagaaaggcattcggagatatggtttttttatccttcctatggatgatgcccttgctctcagcgcggttgatctgtgcggcaggccttactttgaatttgaatgtaattttcctacacctatgatcggtgggcttgacagccagcttatccgggaatttttctatgccgtttcctacagtgctgccatgaacctgcatttgaaaatgatgtcaggcctgaacagccaccatatggcggaagccatgttcaaggcctttgccaaagctctggatatggcggtcggcagggatgaacggattgacggggtactgagcacaaaaggaagtctttgaccaaagcagtcaaaagaaaacagcatgaccgaaatggtcaatataaataccataaaagcggacgaaagagcggtaaacatatgaactcgaaaaaatttttaccatgtatttatctatatcagaaaagggcggtaaacgggctggaggataaacgtgaagtcagcatagatccggtggccctggcggtgagctacagcgataataagtgtgacggtattttcgtatttgatctgtccgaaacggataatgaacatgaagaaaatatcgatatcataaaggaaatctgtgcttccgtggcggttccggttatcggcgccggccatatccgccgtatggaggatgtgaaaaaactgctttatgccggctgcagacaggctgtactggattattcgctggaggataatgtggagatcacaagagaagtttccatgaaattcggtgcggataagcttttcgccatggttgacaacagcaaggtggtgaaagagcaatgcacgctgatcaatcagtatatcagccggcttctcatcaaagagcccgctgttttaaaagaggtggcggaaaacagtccggtgcctgtcatcactacgctgcctgagatttccctggaaaagatcatagagattctgaagctggacaatgtgggaggaatcgccgggaagttggtaaacgacaatattaaggagattcaggctttgaaggatttgtgcaaggacaatggtattgaggtgtcggaaattacggctgcctatcagtgggaggatttcaagaagaattccgacggcctgctgcccgttatcgtacaggactataagacagatgcggtccttatgcaggcctatatgaacgaagaggcctataaggttaccatacataccggaaaaatgacatattacagcagaagccgccaggagctctggattaagggagagaccagcggtcactatcagtacgtgaaatccctttatggagactgcgacatggataccattctggcccgggtggtacagattggagctgcctgccataccggttcctacagctgttttttcaatgaaatagttaccatggatgataagacggacagccagcacaatcccctgaaggtgtttgaggatgtgttctccgtaataaaagaccgtaaggaaaatcccaaggaaggctcttataccaattatctgttcgataagggcgtggacaaaatcctgaagaagctgggagaagaagccacggaaatcgtgatcgccgcgaaaaatcccaatcccaatgagattaaatatgaaatctgtgatttcctctatcacatgatggttctcatggcagaaaagggagtcacctgggaggaaatcactacggagctggcaaacagataacagacccgacataaatatatacaggggaagaaggattgacatttcatcacttcctctgtatatttatttatggaattagttctttttagaacaatccggatttggaaaggggattttattatgaaagctacacaggaaaaagaagcggatctgggaaacagcagcatcggaaagcttcttttcaagctggctctgcctgccattctggcacagattatcaatgtcatgtacaacatggtcgatcgaatgtatatcggccatatcgccgatgtggggcccagcgcgctcaccggagtgggtgtgaccatgcctctgattatggccatttccgccttcgccgcattggtcagcatgggcggggcgcccagggcatccatcatgatgggaaagggagataaggaaacagccgaaaaaatattgggcaactgtaccaccatgctcgttctgatggcggttgtgctcaccgctgtgatcctgctgttcggcaaacccatccttctcatgttcggagccagtgataatacgattggctatgcatgggattatatgagcatttacgccatgggaactatttttgtccagatttcccttgggctcaacgcttttatcaacgcacagggatatgccagaaccggaatgcttaccgtcgcaatcggcgccgtctgcaacattattctggatcccatcctcatttttggctttgacatgggagtgaaaggagccgctctggctacaattttatcgcaggccgtatcttttgtatgggtgctgcgtttccttacttcaggtaaaagcttcctgcgtatacgtaagggatatctgaagctgtccgcagacattatcctgccgtgcatcgggcttggcgtatccccttttatcatgcagttcacggaaagcatcatatccgtatgcttcaacacctcactgcttaaatacggcggtgatattgccgtaggcgcgatgactatcatgaccagtgtcatgcagttttccatgctgcctcttcaggggctgacccagggggcacagccgattatcagctttaattacggagcgggaaatatcgaacgggtaaaaaaggccttccggctgctgctggcatcttctcttgtatacagcaccttgctgtgggcgatagccatgttccttccgcatgttttcatcgctatcttcaccagcagcgcggaactgtccgcttatgttacctggtccatccgcatctatatggcggcatctctattgttcggaatccagatcgcctgccagcagaccttcatagccctgggaaatgcacttacctccgtattcctggctttgctgagaaaggtgattctgctgataccgctgattttcatccttccagccctgctgccggataaagttttcggagtctttctggcggaaccggtagccgataccatcgctgtaaccgtgacagggattctgttcctgcgtgaatacaagaggctgtcccataaaaaagttggcatggactaacattttcgatcatattttttacaaagaaggattttcgcagccggcaaatgaccttccagtctgcagggtgcagagattggaaatgccggacggcagcgaaagccctgttggaaaatccggaggtcggaaatgaatcaagattcaaatacccagcggagactggagctcatgcgcctgattcgtgaggaaaatcataataaccagcagcgtatccgcacaagggaagaaatcctttatggaaaaagcggcagttacagcagttcggatgaatatggctacccgctcagcgcggcagaatattcccgtccggaagaaggagtacatatgtcttcctttggcctgcggcttgttattgcggttctgctgttcggtatttatttcttttgccgggggcaggacctcagcataggcggcattacggcagatcagatagagacagcggtaaatgcgcaggaagagacaaagcttgttgattttatcagtcagtttcctgatattttgaaaagcaaatagtatgtatgaaaccgtcagggtgagcctggcggttttttttgaggatggcagaccaatcgctccggattgctttctgcagaaaggatggggaacttttatataaaaataaaggaaaggttacaaatatatataaaacagccctctttctccatgttaactatagaaatggattgctataatacgtttatcggatatgtctgacatgcacaaatgaaagcagaaaaagaaagagaaaatatgtagaatttacaaaatatatatttgcataatacatgaaatttacataaagtatgaataattgccgaaaatactggaggcagcagaaaagcggcatgcagataaaacaacagattttatatattttcggacacgccaagtaataaaacgtaagaaatcagaattaaaaaagaacaggaggattgcaatgaaaaagaggagcagattattggcaatgatattggcgggaaccatgctggcatccttgcttgccggctgtggcggcaaagcgccggaggttccggcaacagcggagaccggggaacaaaaggagcagcaaagccaggaacagcagcctgcggcagatgtggatactgcggaaaaggaagcgcccatgcttgcggagaaggtagctgcaggagaattgccggcactggaggaacgtctccctgtggctgatgatatcatggttgagccggatgtgttatcccttggcgaatatggagggagtatttccatacgtatgggcgataatgcccgctggaatatcggaccctacacagaacagaatatgttccgctttaaatcggataattccggtgaagtggaagccaatgtgtgtaaatcgtattctcacaatgaggattattcggtctggacgatcgaaatgcgtgaaggcatgaaatggtccgatggagagccctttacggcggaggatgtggtattttactacaatcatatgtctacgccggctttaaacgaagaccgttccgctgttgatgtggatgcggagggttactacagcgcgttcacttcaaagccttacaactgctatcaggtggatgttgatggtgtgaagtactgggcggaattcgacaaggtcgatgactataagtttacggtcacttttgcggcgccaaaaccggattttccggaagcggttgccatagacaataaatggatgtatctgcccaaacatttttatgtggattttgttgccaggaaagacggcgtgaccgatgatccggaattcccctgcatcacggaagaagaagcgcttgccaatgccaataagacatttggaaagcagtgggaatcttacagcacgatgggtaaggatatcggctactattattgggattacagcatcgtccctacaatccgcagttttattgcaacagcggataattggaataaggtcggcgaagtttatgagctggtccgcaatccttatttctttaagacagacagcgaaggcagacagcttccttatgtagacagccttaaattctacattattaatgaagaggatcagaacctgttaaagctggttggcggcgagctgaccattggcggattccaggcaaaggattattccacagttgtgggcgcaacgcaggattcccaccatgtcgtagaatgggattcccctggctggaccgattataattccctcaccttaaaccagaccgtaaaggatcctgacaagcgcgccctgttccagaacaaggatttccgtcaggctctttccatcgcggttgacagggatctgatgaacaatacgattacggacgggatggcggaaggcgttcaggcagcgcctcctgaaggagcccttggctatgacgaagaatggcgttacaaatggacggaatacgatcctgacaaagcgaatgaactgctggatacccttacagaaccctgggacaaaaaagaagggacatatcgcctcatgaaagggactaataaggaactggaaatcatcatgagcttttcagaccttacgggctatggcgaatatatttccattttgaagacctcttttggaaaaatcggtgttaagctttctgaaaaggcaaatcaggaggtcggcacagcgattctggcaaatgatgtggaagcgacgaacgaggttattgcaaccatcaatcccgccctgcgtccagactccgtcattcccatgcgtaacttcatgtgctggtgcagcgcgtacggcaaatggtttgaagatggaaaatccacggcaaacggtggtatagagccggaaggagacatgcttgagctgatcacctgctatgaaaatatcaagaacgcaacgggcgctgatcgggataaagtcattgaagaaaataacaagcgcatttatgagcttcataaggaaaatgtctgggcgatcggctatttaagctccatcccaacctatttcctgatagataataatctgatgaatttcccggaaggaatgattaactgtgatgagttccggtggacctccatggcccgtcccgaacagctttattttgcgaagaactaagggaatgaatacgcaaagataaaggaacacatacctgcagtcgggtatcctatggcgttgaacgtatggctccggccatgcgttcattcgctgtaaaagagaaaggagcagaacctaaaaatctatggaaagattaaaattcattataaaacggcttttgctggcggcgatcacgctggtgatgataagtatcgtcgttttttttatcatccagctgccgcccggggattacgtggataccctggtgacgaaaatggtagccgagggggaacgcgtaacagaaagtgaaatagcccagatgcgggaaatgtatggagtaaaccgccctttttttgtacagtatctgttttggttcggaggagtattaacaggagattggggaacttcctttaattttgatgagggagtgctggacatcatcggcgaatatctggcaccgacactgatactatccattaccacgctgctgttccagtactttgtatccatccccatcggtatttatgcagcgaagcatcaatattccgcaggagattatatactgaccttcgcagggttcatcggtatggcaatcccgaatttcctgtttgcaatcctgctgatgttcttctcctataagctgacgggcacggcggtgatgggaatgtttccggagggaggaattgtggatccggcttcttttctggaatttctgaaacgtctgatcattccggttattgttatcggaaccggcggcacctgcagcgggatacgaagcacgcgggcgctcatgttagatgaacaatcaaaaccatatgtgctctgtttgcgggcaaagggtgtaagtgaagcgctgcttacctggaaatatgaggtacgggctatattgaacccgactgtgagcggtcttggcggaattatttccagtattttcaacggcagcacgatcacggcgattgtcctgctgttacctacgcttggaccgatccttttacaggcgcttaaaacacaggatatttatctttccggcggtattctgctgatttcggcgatcctggtggtacttggcacgttattgtccgacctgcttctcgcggtgctggatccaaggattgaatacatggaggctgataaatgatacgggaaaaagagcagaaaagagcgctgccggaaaacccgtccgggaaatccggcgccgacagggcggccgaaaggcgggagcgcaaggcagagaaggccaggcggaagcaggaaaagtattttacggcttcacagtggcagttaatgggacgcaggctggtacggcataagctggcaattatcagcttcatcctgctggggattctatatattggcatgatatttgcaaatttcctggccccccagggtctggaggattattccggcgcattttccaatgcatcgcctacaccccttcatttcttccatgagggagagtttgtagggcctttcatctatagacgggatatcgaaagagatgaaatgcgcaataaagtatttgtggaggacaaaacgaagccgtacccactggaatttttggtgcatggaaaggcgtataagctgtttggtattatagagactgacctgcatttgtatggggttgataataccgggctgccggagcgggaggacccgctggtatatatgccctttggggcggatcagctgggcagggatctgtttacccgtgtccttctgggaagccaggtttcccttacggtcccgctgcttggcacagcgatttcttttgtgctggcattgattatcggcgggatttcgggttactatgggggatggatcgacacggtgatccagcggctgatcgaggtgctttcctcctttcctaccctgccgttatggatggcgctgtcggcggcgatcccggcagggattccggtggtgcaggtatatatatggatcacgctgattatgtccctgatgggatggaccgggctttcaagaaccgtgcgcagcaaattcctttccctgaaaaaagaggattatgtgatggcggcgaggctggccggtgtcagcgatgccaaaattgtggcaaagcatctggtgcccggttttatgagctatttgatcgtcaatttgacactggggattccgggaatgattcttggggaaacctccatgagctttttggggctgggaatgcgtgcacctgccacaagctggggcgtcctgctgcaggagtgccagagcgtcagcaacatagccaactgtccgtggaaattgattccgctcgtctttgtagcaatttccattcttgcatttaatttcctcggcgacggccttcgggatgcggccgatccttacaagtgaggtatatgatggaagcagaaaataaaaatgtggtactggagataaaggatctatcgattacgattaaattggatgagggaaccctgactcctgtccgcggtctcagccttgctatcgggaagggggaaacactgggacttgtcggggaatcaggctgcggcaaaagccttaccagtaaggcgattctgggaatcaatactccaaactgcaaaacattggggcaaatcatgtttcgggagaacggaaagagtatggatcttttgaaaatgcggccgggagggaaggaaatccgcaatatccgcggcaatcggatttctatgattttccaggagccgatgacttcattctctccgctttatacggtgggaaaccagctttctgaagcagttgcggtacatagtaaaaaggataaaaagaaggccagggaaatcgttgtggagacgatgaaaaaagtagggatacccaatcccgaaaaaaggttcgatcaatatccgcacgagttttccggcggaatgctgcagcgcgcgctgatcgccatggctctcctatgcagcccggggctgttgatcgcggatgaaccgacaacggccctggatgtgacaatacaggcgcagattcttgaactcatgcgcagcctgcagaaggattacgggatgtccatcctctatattacgcatgacctggggacagtggctcagatgtgcgacagggttgcggtcatgtatctcgggcagatcgtggagctggccgaggtgcatgaaattttcaatcatccgctgcatccttatacccggggcctgatgggatccgtacataaaattggaggcgggaaggaacggctgttttccatcgagggtacggtgcccctggcaatgaatcttcctgacagatgtggcttttacgaaaggtgcggccatcgcagtgagaagctgtgctgcggctgcgcacctgtcctgacggaagtaacacccggacattatgcagcctgcctgatgccgcaggaggaaggaagagtttaaaatgggcgaaacacttataaaaatagaggatttaagcaaggttttcttttctcataaggcggaaatcagggcggtggatcatgtcagttttacgatcagaaaaggggaaaccgttggaattgtaggggaatcgggctgcggaaagactacgctgggcagatgtattgtgtgtgcccataaggcgacagaaggcaaagtcctttatcaggctgctgatggtacggaatatgatctgcagacggtggataagaaaacgatgaagtcaatacgcaaggaagtgcagatgattttccaggatcctttttcctccctggatccccgtatgacggtttatgatattctgtcggaaccattaagggctaatttcaagctgccggcaaaggagctggaagagaaggttaagtccattgcacaaaaggtaggcctcaatcccagctacttaaagcgctatcctcatgctttttccggcggacagcgccaaaggattgggatcgcgagagcgctggtgcttttgcctcggctgatcgtctgcgatgaggcggtatccgcgctggatgtgtcggttcaggcacaggttatcaatctgctcaaggatctgcagagggaaatggatctgacctatctgtttatcagccatgatctttccgtggtggagcatatttcggataaagtgggcgtgatgtaccttgggcaaatggtggaatacgctccttcggatatgcttttttgcaggccgctgcatccttatacggaagcgctgctgtcggcggcgccggtagcggatccggatattaagcaggagcgtattccgctggagggggaaataccgaatccggccgatgcgcctgagggttgttattttcacacacgctgccgttattgcgaggaaaaatgccgtaccgaggctgtgaagatgcaggaattggaaaaagggcattttgtggcctgccacagagctgcccagctaaagctttccgggataaaacagtatgaaaggaagcagtgcagcactgcagaaacggatggatgaaaatgaaggatatcattatttttatagacagcggagatacgctggtggatgaatccacggaaagaagggttaacggccgggaggtattttccgccgagctgttccccggcgctgccgaaatactggcaggtttgcatgaagcagggtatcggatcgccctggtggcggatgggctggaggtttccttccggaacgtatacaaacagcatggcctggaggattgctttgagtcgtggacgatatctgagatagtcggaaaagaaaagcctgacagggtgatgtttgaaagcgctatggaaaaaatggggctgacagaatcagacaaagagcgtattgtaatggtggggaataatctggaacgtgatgtaaccggtgcaaacaggctgggtatctgttctgttttggccggatacagcccgcgctaccgtatgcggccggaaacggaagaggaaattccggattatgtgctgtctgatctcagagagctgccgccacttttggaactgttgaacatgcagtatggaaacaggaaaaaaatatgcggcggtaagccgaatgcccgaaaggaatagaaaggtaaggaaggaaaacggcatggacgataactttgtcaaaaatgaaaccgtacaaatttgttccagaacacatctgaatataaccttcaatattttccaatgcggaaattttgatgtggaaccgggaaaatgttttaccacggcggaggatgatgtatttattatgttccatgttaacagcggtgccggccttctggagactaagccctgtacatccggagtagaggagggctttggttttgtcgttttccctgatgtgacatatcggctgtcttctatcggtgaagaaactatgaatattacctgggtagctttttccggctaccgtgcagaggattatctcgggcgtgctgcgatctggccggcacgtccggtttttgaagatgtgggtggaaaatttggaaagaagatgaaccgcttgtatatgctttcccatgaaccaaccaaccgttattgtaaaatggcatctgttctgtatgatatttttggatatctgcgggatatgcgttctcctgttatagaggagggctataaagagaacctgaactacgttgctgcccgggcggtaaattacatagaccataattatatgcaccccatttctgttgagaaaattgcggacggaatgggtataaccagaaagcacctgtgccatgtattccataaggttttaaatgtgactccgcggcagtatattattttttaccggatggaaaaagcctgtaagatgctccgcagcacacagcagtcggtgcaggagattgccgaggcggtggggtatgcgaaccagttttatttttccaaggaatttaaaagaattgtgaatatgcggccgacggaatacaggaagagttcgggggaaattgaaatttttacatggcattcctttgaggccacgctgatgaataattataaattcggtacagaagcagaagatgaggactggagcgtgaaaatcgagccgctcacggaactgccggggtatgattgttgataacggaaaacaggcaggaaaagagaggttaacaatgagtgaactcacaagtgcattactatatttcccttatttatattatgataaaaaagaaccttttcccgtaaagctggtaggataccatattttcagatatacgggcaaaagcctttcgtttgatcgcgagattgtggttgacaggcagaaggtggattatgtaatagaatatgccatttactttgactatgatatccagcatatgtatgatttggagcatatctggatctatgtgggtaaggatggaacggtagtggatgcggaatgcagttctcacggcagatttcttaactgctggagatacaggcccattgcggaggatggccgccgtattacgctttacagccagccggggaagcatgcttttttcccggaaggaaatttgttccttttgttcagtgattatgaggaagtatgtggtgaaaaagcaggggcagacgggttgctgattcctccgcagcttaaggggctggctgccggtaaggcatccgttaatgaacagatacgccggaagatacaagaggagttcgcattccggccctctctggaatttgaaaaaagggaaataccggaaagatgttttcttccggaggaggaattatttcctgctattgccgaaagaatccatgaaatgcttgagaagttagaacgtcagaatcgggaagaaaggatgggctgatttcagagacagaggattcgaaaatattgcacctttttaaaattcagttatctgtttttagtaaaatagcggcggtataatcaactcatcaaaacaaatagggagggacacctgatgaaaaagaaaataatgacagcaattttggcattgacaatgaccgccgccatgcttgcgggatgcggaaagcaggaaacggcagcggatgggggaagtgcggcaggcgtgcagacggaagcggcggaaagcggcagcgccgaggcaagtgcggataataaggacgcacaggaggtaaccctgaaggtattttccaatcttcctgacaggaagaacgggcagggccttgtggaacagaaaatcattgatgagtatatggaacagtatcctaatgtgacaattacagtggaagcgctggatgaggaagcgtataagacaaaatttaaagcgtattccatggacgggatgcctgatgtagtaagcatctggggacagccggcatttctggatgaggttctggaagccggagtcctggcagaactgaatgaagcggattatgcggactataagtttgttgaaggctcactggaaggctttaaaaaggatggcaagctgtatgggcttcccagaaatacggatattgcggttatctattataaccagaagctgttccaggacaatggctgggaaatccccaaaacctacgatgagcttcttacactgggagcggatattaaaggaaaaggcatcattcccatggctatggacggaggagacggctggccgatggcaatttaccttaccgaccttgtgaataagattaacggcagtacgcaggctcttgtttccgaagcggtgaaaaatggtgatttttcggcagcgccttttaaggaagcggcggaactgatgagaaaatccgcggaagccggattgtttcaggatggttttgattcccaggattacggaacggcgatgaatctgtttaccaacggacaggcggccatgttctatatgggaagctgggaaacctccatggctctgaatgaggatatcccggaagaggtcaggacaaatatccgtgtattcaccatgcctgtggtagacggcggaaagggcggagccaatgatattgcagcatggaacggcggcggttacgcggtttcagcggattccaaggttaaggaagaagcgatcaaattcctcaattatatgtatcagccggataagctttccaaatatggatgggaaaacggtgtgggaatgtccgcacaggatcagtccgaatatatgaccggcgacgaaacagaactgcagaagcagattgtgcagatagcacaggatgcggccagcttgtccggcacacctgtcaatgactgcgggccgtcagcttttaagaccagtatcgagagtgaaattcaaagcgttgcgaacggaaccagcacggcggatgaattcctggaaaaaatcggaaaggcctgtcaataaggaatcatgagtctggggtgtcctgaagtaccactttcaggacgccctttttataccctgcatgaaaggaaatttttatgcataaggaatggagagagggagcatgaaaaaattatacagtaataagctggttattttcagcctgatactgccaggaattcttgtttttttattcgctatcctggcgcctatctgtttgagcgtttattacggatgtacggattattccggtatgggaaccgctgaatttatcggaatggaaaattataaactcctcatgaaggatgctacttttggaaaatcgctgtggcactccctgcttctggccataggttttatctgcatccagcatccccttgctattattgtggcagcggttctggataagctgcaggggaaagcggaaggaattttcagatgtatttattttatcccgaatgttatttccgtggcggttatcgcctatctctggaaatttatctataatccggattttggccttttaaataatctgttaaagacgctgggctacacgggaaaaatcaactggttcgactctaaaattgccatctggtccgtgctgctggtcctgatatggcacggttttggctggggaatgctgatttattatacaggaattaaaaacattgatccggtcctttatgaagcggcttccattgacggagcgaaccagagacagaccttcttaaagatcaccctgcctcagatgaaatctgtaatccaggtgaatgtgacgatggctgttatttctgccttgaagcagatggaaacggtatatctgctcacgaacggcggccccggggacagtacccagtttacggcaaattacttatatcagcaagcctttaaggcatttaaatacggttacggcaatgctatcagcgtgctctttattgtgatttgtatcctggtcacggttctgctgaatgtcatttttgcagatcggccggaaaaaggtgggaggtaccataaatgaagacagaaaaaaagaagagtatggccggacgtgttattttatggatggtattgattctggttgcggtaattcagattttccctctgatatggcttgtggacttttctctcgccagcagcaacgaaatgtttaccagcgggcttcttatcattcctgaaaaaatacagtggggaaactatgtgaaggcatttacggacggtcatttcctgcagtatttgaaaaatagtgtattaatcaatggccttgcggttcttttggtattgataatctccataatggcggcttatgcatgtaaacggatgaaatggaagctcagcggaaccgtaaaaaccattttgttgctgggtatgatgattcccatccatgcaacactattgccaaactataaaatttataatatgcttaacctgacagatacgatatgggcgcttctgattccctatgttgcgttttcccttcctcaggctctgttcctgatgaccagtttcctggactccattcctatagaactggaagaagcagcggtaatggacggctgcggcatttaccggatagtgtttcagattgttacccctatgttaaaaccttcaattgccactgtttccataatgacctttttgaataactggaatgaattcatgatggccagtacttatctgagttcttcgaagtggaagaccctgcctttttccgtgctggaatttaccggacagtattcttccaactatgccgttcagtttgccgttatggcattgacggcggctccggcagttattgtatatgttatcctgaataagcatattacgaaaggggtagccatgggagcagtcaaaggataatcggatatgaaatggaagcagagaatcaatgatctgagcattaagaaaaaaataatcgtatacagttatctggtggttgcgccgatcctggtatgtatcagcatactgatgtgtgtgggcagtttctcgaaaatgaggcaggaacaggatttgcgcgcaggaagccgggtacagaatctggatgatcgtctggcggagttgaaccagaatgtatcggagatgtccacctacatatgtatcaacagtgatatccttcagatcctgacaaccggtgacgcggagaaactgaatgaaaatccccagctttggctggaagaagctcccatgcggtttatccaggatacacttgcgatcaaaggatatatcaaaacattgggcatctatccggaaaacggggtccagccttatcttcgctgcatggattccagtgcttacctgccctcattggaacaagtacatgatacacagatgtaccaaaaggccataacacggaaaggaaaaaaaggttgggaactgataggaaaaaattcttcagaggtctattgggcgaatcagagtgataaaatcgtgctttaccgggagatttatgatctctccaaaaagaatgccctgggatatctggtaataggtgcggatgccggtaaatacagggaagtttgcagttcggcgcgggaaaatgaagcagaagggatcctgattctcaattcggacggaaagatactggtttccgaggggaatgtggggaaagagacagcggatatttttaccgatgctaaaaatttggaagcttacgataaatatggcggtgccatactgaaatatgacaaaagcactctgtatctgcggaaaaatgaagaaagcggttttattacctgtctgcttataccggacagcataataacgggcaggctcatggagattctgtatacgcctgccctgatgctgctcggggtactggcaggcctttttcctgtgttgaatcttgtaacgaatattgttacaaagcctttgaaaaaggtgaaccaggccatgctggaattctgtaaaggagatttcgagagacaggtagaggtggaaactcatgatgaagtgggagaagtagctgtctgcttcaaccagatggttacggatatcaggaaactgattgaggataaatatgttatggaactgcgggaaaaggagagcgagctgacggcccttcaggcgcagatcaatccccatttcctttataacactcttgattccctctactggcaggcccaggaggcaggacaggaagaactgtctgaaaacattttatccctgagcagcctgttcagacaggtgcttggtgaggggaaaagcgtgacaacggtggagcaggaatgcagcctggtgcgggaatatctgaaggtacagaaaatgcgtttttccaggcggctggagtataccattgatgtggaaagggagatatatggggaaagaatccctaagctgattctgcagccttttgtggaaaatgcggtagtacatggatttgaaaacatagattctcattgcagcgtctatgtgggtggaaaaaaacacggcagatccatggaattcattattgaagacaccggcgtgggaatgacaaaagaacaggtggattccctgcttgatatggatgaagccgaacgatataagggacagcgtatcggaagatatgccataaagaatgtaaaggaacggctgacactgatgtaccgtgaccgttttgaaatgcgggtggacagttcgccgggaaacggtaccaggatttttcttcgtattgatatgagtgaaggtggatggcaagacgatggtaaataaactgttgatagcagatgatgaagatgccgtacgcatgggaatctgtaaatatatacaactgcatacggatcggtttgataagatttatacggcggagaacggaaaacaggcccttgacatgattatgctccataaaccgggaatcatgcttctggatgtaaggatgccgctgatgaatggcattgaggtgatgaaggaagcggcttccatgggaatcctgccggtaacggtgatactcagcggatatgatgaatttgcctatgcccagcaggcactgcgttatggggctaaagaatatctgctcaagccgacccggtcttcggatattttaggccttgtcaaccgcctggcagatgaattgtacggtaaggcggttgctgcagctaaagaagaggggaagaacgataaagacattcccgcagcgctgcagagggcggaacaatttatcagggagcattaccatgaggatatcatggcctctcaggcggcggaatacgcgggtattacagcgggctatctttctaccctgctttcccaatacagagattatgggttcagtgaactgctgaattccatacggattgaacatgcctgtatctatctggaacagggatacctgaaaaattatgagattgcttataaggtgggctatcgggatgaaaaatatttttccaaaacttttaaaaaggtgaagggagtgtcaccggcggagtataaaaacggtataaaaacggcagttggatgtatagatttatggaataatagatgatataataaatagacaactctttccaggtggattgtggaatgttttccggcaatacaattttaccatagaccggtgaagagttgttttatttatgcaaacagaaagcatctcagtcatgcattttttgtgttttgtaaatgtttgtattacataaaggagaagagtgataatggataatttatctttgcagcacatctgttacctggttctgttattttttgtattttcagtattaggctggtgtatggaagtactgcttaagtacatacaataccatcgttttataaatcgcggctttttgataggtccctattgtccgatttacggttctggtattgtatttattacagtaatggtaagtatattatctggtatggagtcctctgttggaacaacattcagcatttcctttataggctgcgggattctggaatatgctgtcagttattatttggaaaaaaggtttcatgccagatggtgggattatagtacaaaaccaatgaatcttcatggacgtatttggattggaaatttgattctgtttggaattggcggcacattggtgattgaggtaatcaatcccattatgtattcattgtttgcgctgattccggagagaagtctctatttgcttacatgtataattatacttacaatgtctgcagattatttgacatctcattttgtcatgaagtttgttaagagcagtgtagaaagtagtgaagctgataatacggagagtataagtaaagagataaagcttcttatgcataataaatcaattctttacagaagaattgcagatgcatatccggatgtcatttatcgaactgaccgcatcaataagagaatgcgggaaattaaagccgaaatagaacgtatacagcaagaaactgctgataatttggatcgcataaagcaagatgcaacttataattttgagttgatgaaagtaactccttctcaaatacaagaggaaattatagataaacaggatcagcttattttacagctaaaagaggataatgcagatgaaaaggcgatagaggaattgcagatagaaattcaggagaagaaacagtatctggaagaacggaaaaatttatatcgtattagataatgaaacagaaaatttcaaatattctttaacataaaaaggagtatctgataatcaaaaaagcgaatatataataatgaaaatactcactacatatgctataataatttaaaaggtgttaagacgtagcataatacttttaggcagcggattatattttagttgtcagaaaaggtactgtaaaatgcttcctttattgtaaacatgcagttttagcggtacggttatattggttgaagggcataatggatagtatggaaagagaggctgttacatatgaatgaactaaagaatattaatgaatacggaacacagtcggaaaaaccatttttgctgatttatacgaataaagataatgttataaattatgaatggctgaagacaaaagaagaattattaaaggttatggaagaagtcaaaggatatgggtgcgaaattcatgactcaacgttaatagcaagctgccgggttgagtttccataaaagtatacgttaaccggaataattacttaatatggagtatttaccatgaaggaaataacgtcgccctgcccattttgatattggacatggcagtcatggggaaattccaatctgctgtcaaatcgtatagccacatcttttacaggattaagttcaactaccagatctttccgtgcattatctctccgtaatagtcaatgcctttttatttgaatatagatgtttttcctgattaatatactttatcttcgcagaaactttaaaatttatatggttttagggggattccttggtgggtaataaaattatattaaatatggtttcttcagttatagcaacaagtttaacctttatgatttctccgaataatactgccggacagctgatttcgggtatttcaaagcttatacccgacattttagaaagctatcttgagaaaacccaagtggaagagaagctgataagaatctttaggaactctattcttgaagccctttccggagcggaactggaaatagatatatttataaaagaaaggattgccgacgagatagtttccgggaaaagggattggagtaacctgacagatatattgacagagagctttgaaaaatacgatgtttggttcgctgatggatattcctgtaaggcagaaaaaatagcggatgatatcagcgcaagaatgaacagcaaactagtaaatgataagcagctgagtgagttcctgaattttgtgcggttagatttcctgacgaaaaaagtagatgaattatacaaaaaattggatttaaatgaacaggatgctttattattattcagggatcatcattatcaaagtaaagcagacgagactgtaaatttcagtctttttcctgaacttaaatttttggaggaaaataggacaataagcggagaaccatttgcttcaccgctatcggtatatttcaaaagaaattactgctgtatagagaatgagaatcaatttctttgcccttccagaattttactattgggctccggtggaacaggaaaaacaacagccttgcatgatctgctgtgcagcctgctggacgaaggtatgtttgctgtgtatataccgctgcctgtaatcagtacatattattctgtttttgattatatatctgacacaatatttttaagaaacaggcaaaaggcagggctcttttttgaaagatacggaaacagccgccaaatggtgtatctgctggatggttataatgaagtatctgaagaaaaccagggggctgttaacaggcagctgcaggaattgtttacggaaaacgtccacattgttatttcatccagagtccggctttcctatgcattggaaagaaatgtgaccgctacattgattattcagcctttggaaagaaaaaatatcatatcgtgtatgtctgaggggcaattagaatttccggataaaaaagaggaactcctgaatattttagatacccctttaatgttggtactatatacacaaatgaaaaaccgttaccaggagttttttcagcttcccgaatggaacaagaaaaatacaaaggcggctgttatctggaacttttttcagtgtgagtatttgaaagcagtacaggaggacagtacacagggagaaagcttgctatggtatgtggtttactatgtaatcccatatattgcatggaaaatggtgagtttggaaagtttttatattaagtcggttactgaattaaatgaatgggtgactgaatgtattttattaaaaaagtatcagacgagaaaaggcagcctggtaaatgacttttatgacattagcaatgataaagtggattctgtgaaaatcataaagattttatcaggattattaataccggtatcctttggtgaacataaaggatacggcttcaggcatcagaattttagggactgccttgcagcgattcattgccttaatatgatagttcctcagagcgggaaaactccggaagcatggaaggattatgtacttccagaagaaattcttcaatatattaatgaacttgatgaagcggatcgggtggaagaactttggagacgtaccggagacggtcgggaaatgaaagattcaggatatacaatatataacatagtggagtttttcaaggttaagtataagtatgatctatccggaataagctttgcaggccaggatttacgaggaatatcattaaacggtgttaaactttgcagtaaattgcacagtgcagatttcagaaaagcatggatagctgaatcaacgcttttgcctcagggacataagagttttatcaactgtattgcggtaacctctgatggaaagtatgtggtgagcggttctcaggacggaacgattataaaatgggatttaaggactggaaatgtggcagggggtccctggcatgtggaaggcgatgtcagggcgatagcaatagctccggataatacatatatcctttggggcggcaatcagcctattatacataaatgggatcttgaaacaggaaaggaactctgtgaaccatggaggccatggaaaaaagaagaggaaaactttgtttcccgtatttatatgacagtggatggacaattcgcttttgtatcaggcattcatggccatgggattcttctgaatgctgatactggtgaatcggcaggaggagtaccggaattggtttccggcaggctgggaaaagtcatattcacaccggataaccgctatgctgtcagctcgaatctttcgggggatttattcaaatgggaatttttaaccggggagttagtctgggcaaagaaaaacgcaggtatgtttgattatctagaactgactatggacggaagccatctcgtttgtctggtgggagaggatatttgccgtgtttgggatattgataccggtaatatttcatatgagtataaactattatttgaatgtgaaagtaaaactatggttttaactccggacggtatgtatgctattatttgccctgaccattatacgcctgtaaaaatagatctcataacaggcaaacaaattggggcactctgggaacgtatgccggacaggttgattgaattagttattacgcctgatggacgatttgtaatcggtgttacatataataatgaaatttataaatgggatacttctaccggagagctagttggacaaatctggagattgtggaatgcctcagttacggatattgcagtctcaaaaagcggtgaattcttttacagcgccgcagaggacggattggtttcaaaatgggaggtaaaaaccggtcgtccgctttgggtgtcagaaaaagagcataaaggagctgtagcctgtatcaggctcacaagtgatgaaaagtacctccttagcggatctgaggatggtaccattataaaatggaatacagactggggaatacccgaaggagatgcctggtatgaaaaatctgaaacgggggctgtaaggacacttgatattacaagtgacactaaatatgtgatatccggatcggatgatggaaatttcagaaagtgggaattcgcaacaggcaaaaaagtgggaggtccatgggatggatattttaataaacagaataatgtaagaatatccagagatgacaagtatttcttctgcggatatgccaccttctaccttagaagcccggaagtagattatatatcggtatgggatataaatacaggtgaaataatatgtcctaaataccattcatatattccgggttatgctcgtataactctttcttctaatgagaataccgttttcggaggagtcccgaacggatctttgtttaagggtaatacatctccggttcaaaactatatggaagtaaaaaagttcggttatggcgttcatctaagcaaaattaccggcatcgcactaacatcgaacgattcctgtatctattgttcagtgtctaacggagaaattggtagatggcaaacatatggtttattttcagaaatttttgtgaatattcatcctgatttccccacgtgtttagatatttttatggataatagtaagctgatagcaggatgcagtgatgggacaatacgaatctgggatttgggaacgaaagaactcctacgtgtatttagacggattccgaactgtaatatctgtggatgtcagttccagggggcactttttgagaataaggaattgcagtcgtttgtaaatgcgagtggtggaaaaactgattttcaaaagaatcgtgaatgaacatcaaattacattttaatatggaggtctgtctgcatgaataactgtatgatatgtgaaaggattgaatggattaaggccggaaagaatccatattttgtaagagaactgaacacaggctatgtggttatcggtgaccatcagcggattaaaggatatacactctttctgtgcaaagaacacgcaacagaactgcacttcctggaacccggcttccgcatggaattcctgcgggaaatgtccctggtggccgaagccgtttacaatacattccggccggataaattgaattacgagcttcttggggcaggcaccggccgtcacatgcattggcacatttttccccgtagaaccggagacacccctgcaggaggccctgtttggagcctgggagccgaactgtttgaagaaaaatatcttcccggaaaagaagaactggaagacttgaaaacacagcttaacagggaactggacaagctattaatgcaataaaaattgagttgttctatgaagtgttctatggaaatacctggccagtattttccatagaacattttgtttttatgcttccgaaaaataattcatggcaattgcataagtacagagaaccatgaaatagttaccattatttatatgaaacttttattgacacgaacaccgtgtcatgctttatacttaaatgagacgctgcaaaagctggaagacaaagacgtgcggataatttatcttccgccaatgaccgtagcagcggctcacttttcggggaatgctgaatatggagtggggcaggaagcgaccggcatggttgagaaatttgtgtacgaaacggaactgctgaaagtaaaacccgatgcaagagggaggggatttgattgttccagagcggatttaagagtggaagtagggctaactcctccaactgcccattaaggaaatgacaaaataaaggataagggaatgagtatgagccatggcgagacagtaattcaaaaaccaatcagtgagtatgcggtttatctaaaaagcctgttaccggcgaacatacctgacacatatgcgctgaaaccaatgtttaaaaacatatcaagtgaagaaaatatccgaaacggcgttattgccttcagagattttttgtatttattttgtgatcgtttaatttcggacggacatttatacgctaaaccgcagagaacaaagaaccaattagactatccgtttctgaagaatatgaatcacctcttgattgacataggttataatggcagtctgaatgaaagcggcgagtctttattaatctctgaaatcccgtcatttacagacataaagcccaaaatccctgcatctaaacagatggagtatctgcgatttttagctctttgcggttttgtttttacaggcattgatttagatgccaagacatttcatatgccagatggctttttagaaatatcttatcctaatgcaccagtcatgctggtggggttaaaggccctgtcaatggctgcagtggaattgtgggtgaggttttataataacgccaatgatcttttccggtgtgattacagggtaatgaaggcggaggatacggatttgctggatgttttgaaggatatggtatatctattgcctgaaaacatccaaaggtttgccttagaattacataagcgctatatagacaaggaaatgacctgtgcagtcataaacgacactgcaactcattttgcgtatgcttatacaaaaaacagcaggcggcccttatcaccgcgggatatctattcccgcagaatatgggaatttgaagtatcaatgaaatacggttattgtatcgttgtaagatccaaaaatacggataagtatgcagaccttatcaaaacatttcccctgtttttacgtgaaaagattacagcgggctatggctgtgacagaaagctgcgtaatgaaccctgtcaaggcggctgccaggggatccgcatacctttgaacgattctaccgttgccatgaaacgagatattgaattatggcttgatcatgaggtaccatcttcgtaaatgacataacaataaaatcagggagtgattaggttcaggttttgttctcatttgtatcgatgaacacgctgagaaaggagtcgctggtggagcgaatccgggaaggataatcgtttcttggcatatattttcaaatgtgtgacaaaacaaatgatacgttacagtaacttatttttcgtggaacgctgcatatggagtggagcaggaaacgaccagtatgcatctcaaatcattggccgtccatcataacactctgatgaatatcagattgtatattttcacagccttttccggattatgttctgccgaatagtgttgcttaataccgtgaaataaattataattatgcattgtggcacattattttgtaccatgttatgtaattgagattaaaattttaaaaaaaggaactgattttcttacaaaaaggggtgaaaaaatgaagcaaatcagagcagctgcggacgtaaatccaggctcctttcgattcacattggcctttactataaataataatatgctgaattcagcacaataaataaggaaaaaccatgagaaaactagcattagatgatgaaatattattaagtattcaacagccggcccgctatatcggcggagaggtaaacgcagtaatgaaggaaccggaagaggtagatatccgttttgcaatgtgctttccggacgtatacgaaatcgggatgtcccatctcggcattcaaatcctatatgatatgtttaacagctgggaagatacctggtgtgaacgtgtttattccccatgggtggatttggataagatcatgagagagaagggcatccctctttttgccctggaatcccaggatccggtaaaggattttgatttcctcggcatcaccattcagtatgaaatgtgttatacaaacattctccaaatcctggatttgtcaggcatccctttgctggcacaggacagggatgaatcccatcccattgtaatcggcggaggcccctgtacttataatccggagccaattgccgaattctttgatattttctatatcggcgagggggaaaccgtttaccggaatcttctggacatgtataaagaatacaaaaaagccgggatcagccgccgggaattcctgatacaggccgccggcctgccgggaatgtatgtgccttccctttacgaagtttcttataaagaggacggtaccattgcatcctttgaaccaacggtggaaggagtaccccgaactattctgaagcagatccagatggatctgacggaaacctattatccgagaaagcctttggttccctttatcaaaatcacccaggacagagtgactctggagatacagagaggatgtatccggggctgccgtttctgccaggcgggtcagctttaccgtccggtaagagagcgggatgtggatatgctgaagcagtgtgcggtggatatgctggatagtacgggacaggatgaaatttccctgagttccttaagctccagcgattattccaaattggaggagcttgtaaccttcctcatggaaaccggacgggaacgtatggtgaatatttctctgccttctctgcgcattgatgccttttcactggatatcatgagcaaggtacaggatgtgaagaagagcagtcttacttttgctccggaagcaggcagtcagaggctgcgtgatgtgattaacaaaggattgacggaagaggttatactgaaaggcgccgctatggcctttgaagggggctggaccagggtgaagctgtattttatgctgggccttcctacggaaacggaagaggatatcaggggcatagccgagctttccaataagattgccgcccttttctttgagacagtccccaaagaaaagaggacgggacaggtacagatagtggccagtacctctttctttatccctaagccttttaccccattccagtgggcaaaaatgaacacaaaggatgaattcctggataaggcccgtctgactaaaacggcggtaagagaacaattgaaccagaaacggattaaatataactggcatgaagcggatgtgagtatgcttgaaggcgtatttgccagaggtgaccggaggatcagtgaagtggtcctgaaggcttataaaaaaggctgtctttatgactcctggagtgaattctttaaaaatgatgtatggctggaaacctttgccgaatgtggcctggatattgatttttacaccaccagggaaagagggctggacgagattttcccctgggatttccttgactgcggcgtttccaaagaattcttgaaaagagaatggctacgcgctcaggaaggtatagtaacgccaaactgtaaaaggcagtgccagggctgcggcgcggcccgtttcggtggagggatttgttttgaaaaaagaaatgatgcaggtgaaattgaggatggcgcggctcagactcttacggaatatgcgcatctgcatgcgggtgacgggccggtggaatatgctgccggtacggaaggaggtatgcaggcatgaaggtacgtgtgaaatttgccaaatatgataatatgcgttttataggccatcttgatgtcatgcgttttttccagaaggcgctgcgcagagcgggaatagatgtcgcttattccacaggcttcagccctcaccagataatgagcttcgcatcgccgcttggggtggggatgtgcagctatggggagtatatggacatagaactgcgttcattagaactgcgttcattggaattacgttcagcggaaggtaaatcaaacgagatttgcaggcgtctgaatgaggcctgtgtcccggggatagaagtgatcagcgtgaaagccctgcctgaaacggcaggcaatgcaatggccagtgtggcggcagccggatatacagcccatttcaaggattctgtctccgattttcattttctggaaggttttatgaatgattttctggctcaggatagtattatagtaacaaaggaaaccaagaaggggacatcccagatggatatccgtcccgggatctatgaatgtaaggtgacgccggaaggtattcttgcatttaccgtggatgccagcagcggaggcaatatcaaaccggccctgcttttaggcgcattgtggaaatttgccgggatgcagcaggagcttcctttcttgggaattcagctgacacgtacggaaatctataccaataccggcacacaggaacagccggtttttgtatctctggaagaagtgggtgaggacttttgaaagatgcaaagcttatcgtcctgaaacaggaaaggcatattttatccctccttttatatgagggaaggctcatggaagccaatgcctatccgcttccggcggctggccccgcagaggaagcggagggagcttccggaaatgtttcctgtttgctgggaagcatctatgtaggaaaagttaataatgtagtaaaaaatatcaatgccgcttttcttgaactcaccaaagggcagcgggctttcctttcccttgataaccgcaatgagccccggctgctgaaccgtccctatgacgggaggctgctcgcaggagatgaggttctggtacaggtggaaaaggaagcggtaaaaacaaaggatccggtggttaccacagagctttccttttccggaaggtatgcggtccttcttcccacaggccgtccgggcaggctgattttttcaggcaagctggataattcctgtcggaagatactgaagggtttcctggaacgggaagaaataaaaaatgttctggaaaggtcttccctgattatccgtaccaatgcatcggaactgacagagggcgagcctctggtacaggatattctgcggctggattcccttgccgggcagatcctttccgtagccggaacccgtacctgctacagctgtctgtaccgtccggcgagcgcttatctgactgaaatccgggatacataccatgatcagtatgatgctatcgttaccgattccccggatttatatgaggaggccaggctttttctggaacagcagtgtcccggagaactgcataagctgaagctttatcaggatccgagtgttacgctgatgaatctgtacggattatcggctaagctgagggaggctacagagacgcgtgtgtggctcaaatccggcggttatcttgttattgagcccacggaggcccttacggttatcgatgtgaattcgggcaaatacagcggtaaaaaggctatcagggataccttccgcctgattaatctggaggcagccgcagaaatcgccagacagctgcggctgcggaacctttccggaattattattgtggattttatcaatatggaggacagcgccgataaacaggaacttcttcaggccctttcccgggaactcagacaggatcccgtgaaagcggttgtggttgatatgacgcccctgggccttgtggaaataacaaggaaaaaaatccgcaggcctctgcgggagcagcttaatgaaacagactgacaggagagtgacagcatgcgcctgcttcgtatgaaaaaaatacatgaaggttcatatctgaataattatgaactgacctacctgaacaaaggaggcagggagaaggtgtttgaactggtaagccgcagccgtctttcctgcgccggggatatcgggcgtcaggtgaacggtgtgactatagtggcttttcaggatgacaggctgcttcttcttaaggaattcaggatgagcatcaacaaatccatttataatctttgcgccggaatgatccaggacggggaaagtgtggaggagtgtgcaaggcgggaactgtatgaggaaaccggcctttccgtttcccgcttcctggatattctgccgccttcctattctgcggtagggttttccgataccagcacctatcttgtgatcgtacagacggagggcagtttttccgaccatacctcagaaaatgaggagatcaaagccggactttattccagagaggaaatcagggaaatgctgaaaacagaagaattcagttcccgttcccagacggtggcctatttctttgcgaacggattttctttgcccggactgcataaagaggaaatgtaaaatgaaaacattgtatgttactgatttagacggaacccttcttcgtaccgacgatacggtaagcccgtttaccataaatacggtgaacggactggttgacaaagggatgctttttacttatgcgacggcccgttctctggtttccgcttccgtggtaacaaggggactttccgcccggattccggtgatcgcctataacggcgcttttatttataatgcagagacagggattcccctgtattccctgtttttcactcctgaggagagcgcttttatcatatcccttctgcagagcttccggctatacccatttgtatattctttccaggaaggaatcgaaaggctcagttggatgtcagggacggaaaatgaaggctgttttaattatctgagaaaaaggaagggtgatccgaggcttaatcctgtatcggatgaaaaaagactgtacgcaggcgatattttttattttacctgtatcggtgaaaaagaagctcttcagcctttttatgaaagaattgcagcaagcggcctttttacctgtacccttcagcaggaattgtatgagacggagtactggtgtgaggtcatgcccaaaaaggcaactaaggcaaatgccataaacagactgaaggaactgtgggaatgtgaccgcattgtttcctttggagattccctgaatgatatttccatgttccgcatctccgatgaatgctatgccgtggaaaatgccgcccctgcgctgaaagagcatgctgcgggcctgatacctgtgtgcgatgaggacggcgtggccaagtggcttcttgagcatgtacacctttaagcacatacaactatttaatagaatcctttctttagagtcatcttagagaaaagtctgctatcctttttatgagcgtgaaaaatgctgaagggcagcagactttttcactgtaaataaaacggaagagaaaggaatgggaaaatggaaattgacaagtacgtaagaaatgcaggcatatgggggagccggaaaagcctgactgccgtacttttggggattttgcttcttgcagccgcatgtctgggaggctgcgggaattcacaggatatgtttgtaaggattcctgaagaaacattgccggcagatcaggaaagcagtcaggcgggaagcccggaaaccggaaaagaaccgggaacaacggaggcttcagagacggagccgtccgaagaaatgattcaggaatctgaaaatcttcctcaaaaagagacaaatataccggctgcttccgggactcaggaactcaacggatccatccaatccgtaggcagctatggctttacggtataccagatatttaatgaacaacaggaggacggaggaatgattgcctattcttccaaggaaaaaaataccttggtggacgtcagctttacagagcggactgtctttaccgtcacctcttcctcagacggagggattacctcatccagcgctccgggaacaaaagctgatttggaagtatcccgcagtacatatatgacaggcatgtgggaagggaatattttcatcgcagatacggtaaccatttatcattttaattaatacagagcaaggcctcctttttgcttgaagtataaaattatggaatatataatggagtcaggatcaggaggtgccttatgcttaaaataggagaattttccaggctgactagagtatctgtgcgcatgcttcattattatgatgatatcggactgctgaagcctgttcagacagataaatttaccgggtatcgtctttattcggtttcccaggttgccgccctgcagaaaatcgttatgctgcgggatctgaatttccagatagccgaaatcaggaaggctctcggatattggtcggatgaaacattaagggaagaactcaaccgaaaaatacaggaaaaacaaaatcatattataaaagaacagcagcagattcagaatttacgttcggcaatagaaagcatcaataaaaagcagttggatctgcattaccggattatcatccacgaagtaccttcccggcatgtgatctcttacaggaagaggatacctgattattcctgtgaaaaggaactttggaatgagttatattgttttataaaagagaatcatatagaaatatccaggcagaatgataataatattactatttttcacgagaacaaagagagtgattccggggtggacgcggaggtctgccttttggttaaagaagagcgaacgtcttcaggccctttccggtacaggatagtggacggtgccgaaaccatggcttgtatgatggtccggggaagttatgtaaatcttgacaaggcctatcaggcctttctcggctggcttgaggagaatcctcagtatcagtggtatggggcaagcaggcagatatgccatcgggatcccgagaatgaagaaaaggaagaggattatctcacagaaattcaaataccggttaaactgcgaaacggctgataaaaaaatcagccgtttcttcttgaccctgacacactgtcagggtttatcctcagatcagatgccctgatacgaaaaggagaagactgctatgacaggaaatttatttaagatcacaccaataggccttatttatgaagagaatggcagaataactgcggaagtaaacggaaacttatgcaaaggcctgaaatatatctcgctgttcagccacatcatccttttatacaggagtgaaacacagcctaatatattaaatacgaatctttcacaaagagtcgtcaaacttgaagaagtccgggaaaaggaagggaagctgataattggaagcttaagcggaatggaggtaacacgaaatcttctttatgatattaaaccttattttcccaatgaggatcgggttaagaatgccatggccccttcccggccattccaaagttttccatccttatgcaaggatagcttaacccggctgggaacgatacggaaacagcagggcagctgtttcctcgaaataccggaaaattttgaaacctggagcgatgctctccggggcttttcccatatccgtgtcatatggtggtttcataaatttgaaaaagaatgcttccgaaatactctggaatgtgacccgccttatgaaaatgctccgaaaacaggtgtctttgcttctcgttctcctgtcagacctaatcctattgccatgacaacagcaagaataataaatatagataaaagaacaaaccggatacaggtatcccttctggattgctatgacagcactcctcttttaggtatttgcccctacctgccggaaagagattttattccccggtaccgtctgccccagtggctggagcattggcctcaatggctggatgaccggggtttttcagcggcacaggagcctttactgcagagaaaccccgcagagcttctgttcagatatagaaaagtgatgccggaaagcggttctcgtattgcttctttctttgcatccttgcaggacatgccgcttttatccgaccagggaatcgttgtgaaaggtgcgagacagaataatctgaaaaatattgatgtgatgattccttatggaaaggtcaccgtagttaccggtgtcagcggcagcgggaaatcaagcctggcttttgataccatttatgcggaaagccagcagagattcctcgcaaatatgtctcttgcggaacgttctcagttatccgtgccggaaaagcctgatttcgatcaaatatccggtttgccgcctgccatagccatctctcagaaccggataaaccgtaatccccgttctacggtgggaaccgctacagatctttatactctgctgcgcactttatttgcaaatataggcgtacggcattgcccggaatgcggccgggttattaaaaaaatgaatgctggagaaatcgtggaatccctaaaaaactgtaaggccggcacagtcatgaaaataaggccttttcatgacgaaaaaaaagtccggacattcctttctgccgatgcgatggatattgattatgaggaatatcttcgtacctttgataccgccgtcaggaaggctttggaaacaggaaaaggagctattgaagtgcagctggatggtgaagaacctttcctgctccagaccactgagatatgctgtcactgtgattatgttttattcgaactgactgcgaccgatttcagcttcaacaatccggaaagcatgtgcccggtatgcagcggacttggacgtattatggatattgatcccggattaattgtgagtgatccggataaatccctgttggacggggcttctcccttctggggaagtctgcgcagatttaaaacatcacccaacgcaaactggatgcggggagagattcttgccctggcagatgatatgggaatcgatttggaaagagcatggaaggagctgccggaagacttccggacacaggcgatctatgggagtgcaggaagggaagtatctttttcctataaaaataaaaatggccgtgccggaaccattacccgtccggcagaaggcgcatataacattctcaaaaggcttctgcagtcgggagggacagaaaaacaaaatgccatgctggaaccgtttcttcatgaaaagccctgtgattgctgcaagggagaaaggctgaagctggaaagccgtctggttaccgtcgcagatgtacgtttcccggaagcaatccgcatgaatatggaagaactgttgcaatggatttccggtcttccggaggttctgaatcccgcacaagcggcttctgtgcagcctgttttacaggaaatatatatgaaattatccgattatattcgtattgggcttggttatctgtcacttgatcggccggttccgactctttccggcggtgaatggcagcggctgcagctggtggggcagcttgggagcgggctgtccaatattctttatattctggatgaacctacggcgggactgcatcccaaagattatgacaagctgatgcagatcataaataaactgaagaacctgcataacacggtcctcatagtggagcattcccccgccgttatcagggctgcagacaatgtgattgatatcggaaaggaggccggccagacagggggatatgtaattgctcaggggactccatcggaaatagcggaaaacaaagacagtgaaaccggcctgtatctgtccggaagaaaggagattaagcgggagcaccctgcagaagccggaaacagcagaatgattgccattaccggaattaacggaaataaccttaaaaatatcagcattcagtttccggtaaatgccatgacctgtatcaccggtgtcagcggatccggaaaaagcaccctggtaaattacggaatccttcccgctgtccgggcctgtgccgaaaaaaaagcagcagcgaataaaaagtatgatacaataacaggagcagaggatatctgccgtatagtgcacatcacccaaaaacctattggccgttcttctcaatccacaccggccacctacacaggactaatggacgaaatacgaatccttttttccaggacgccgacagccttgcgcatgggctattccccgggcagattcagctataacagcaaagacggacagtgtcctgtctgccggggacagggttacaaaactctcgatgccgcctttatgttttcggcaaaaacacaatgccatttatgcaaaggccgaaaattcaatgaaaatactcttcaggttcattataaagggaaaaatattgcgcaggtactggatatgagtatccgtgaagcggctgtcttttttgatgataataaaaaactcagtgagactctgcagcttttaaatgaaatcggcctgggttatctcattcttgggcaaagctcgctcactctttccggaggagaagcacagcggattaagctcgccgcgcagctgcagcagaattccggcggaaatatactgtatcttttggatgagcccacggcagggctgcatttcagtgatatcagaaatcttctcattctattggagaaaattatttccaatggaaacacggtaatagtcgtggagcataatccggatatgatccgcagcgcagactgggtgatagatctggggccggagggcggagacagaggcggcaggctggtggtacagggaacggtttcggatctgaagaagtgttcagccagccataccggccgcatcataaaagcctattaaaagatggaaaattattgtttttctggttgacacctgtcctcaccgatgctattatatatgagtatgccgcataacgaggtaaaagtatgtcctttgggacatcaccacagttagcgagtttttgaaataggaggtgccctatgtacgcaattattgcaacaggtggaaagcagtataaagtttccgaaggcgacgttcttaaggttgaaaaactgaacgcagcagaaggagatactgttacatttgaccaggtaatcgcagtgagtgacaatggccttaaagcaggcgcagatgttgcttccgctaccgtttccgctactgtagtaggcgaaggcaagagaaagaaagtcatcgtttacaagtataagagaaaatccggttatcataagaaaaatggtcacagacagccttacacacaggttaagattgaaaagatcaacgcttaatcagaaatcatgacgaagatattagtcaggaagacaagcacaggtgcttatacgggttttacctgtatcggccacagcggttttgctcaggcaggcaatgatattgtctgtgcatccatttccgtccttgtaattaatgccatcaattccattgagcagtttgccaaggagaagatgtctgtaattaccaatgaagaggagggtttaattgatgtcagatttgccaatcctgttaatgagaagaccacactccttatggattccctgctgcttggcttacgggaagtgaaagaacaatacggtagtaaatacctgaaacttcaattcgaggaggtgtagatacaatgttaaaaatgaaccttcagttttttgctcataaaaagggagttggttccacaaagaacggcagagattccgagtccaagagattaggcgccaagagagctgacggacagtttgtaaaagctggaaacatcctttacagacagcgtggaacaaagattcatcccggcattaatgtaggacgcggcggcgatgatactttattcgcattagtagacggtgtactgagattcgaaagaaaaggaagagacaaaaagcaggcttccgtttatcctgtagaaaaataagtacgtatctgccgggcttcaaacattttttgtttgaagccctttccattataaatttatagccgcattcattgcggattgaaaggactttatatgtttgcagacagagcaagaatttatgtcagaagcggtaagggcggggacggtcatgtttccttccgcagagaaaaatatgtacctaacggcggccctgacggcggagacggcggacggggcggagatgtcattttccaggtggatgaaggtctgaataccctgaccgatttcaggcatgtccgtaaatataaggctgtggacggacaggaaggcgggaaacgcaactgccgcggcaaggacggggaagatattgtgattaaggttccggaaggaacggttatcaaggaagcggaaagcggtaaggttattgccgatatgtccggtgacaacaaacggatcatactgcttaccggcggacggggcggaaacggaaaccagcattatgccacaagcaccatgcaggcacccaaatatgcccagccgggccagcccgccagggagctggaactgcttcttgagctgaaaatgatcgcggacgtgggactggtaggttttcctaacgtagggaagtccacccttctttccagggtaaccaatgcccgccccaaaattgccaattatcatttcaccacccttattcccaacctgggagtggtggatttggacgatgcgaagggttttgtcatcgctgatatcccgggcctgattgaaggcgcttcggaaggtgtggggctgggccatgaattcctgcgccatattgaacgtactaaggtaatcatccatatggttgatgccgcaggtacggaagggcgggatcctgtagcggatatctatgccattaacaaggagctggaagagtacaatatggaaatcgcttcccgccccacagtgatagccgcgaataagatcgatgccataaccgacacggagaataaccccattgatgcgctccgggcggaatttgaaccgaaggggatccgggttttccctatttcagccgtcagcggagaagggctgaaggagctgctctatcacgtgagcggccttctggataagacggatgacaagccggtggtttttgaacaggaatacttccctgaattttccaacagctattccaacgaaccttttaccgtggaatataacgaagaagaaaatgaatatgttgtggaaggtccccgtattgaaaaaatgctgggatataccaacctggagtctgagaaaggctttactttcttccagggcttccttaaggataccggtattcttgaacagctggaggaactgggaatccaggaaggcgatacggtccgcatgtatggtcttaaatttgattattataaataaaccgaatacgggaggaaatacgaatgacaagcaaacagagagcttatctcaaaagccttgccagcagcctggatcctattttccagattggaaagggaagtcttacgccggaagtcacggaagcgatctccgaagcctttaacacaaaggaactgattaaaatcgcggtgctgaaaaactgttttgacgatccgggtgaaatggcccagatgattgcagagcggacaaaatcacaggtggtacaggtgatcggcaaaaaaatagttctttataaagaaagcaaggatcataaaaaaatcgaacttcccaagtgatgcggaagccggcggcggagggattcttcatggatacagttatgggcaggcgtaaaaaagtaggaattatgggcgggaccttcaatcctgtccacatgggccatctgcttcttgcagaaaatgcatattccatgttttcgctggatgaaatcctttttattcccagcggatgctcttatatgaaggatcccagggggattctggacggtcccaccaggcttcatatgactgccctgtccatcagtgacaaccctcatttttccttgtcctccatggaaattgacagaggcggctatacctacacctgtcagactctggaacagctggaacaggaaaatccggactgtgattattatttcattatgggtgcggacagtctttttcaaatggagaactggaaggatcctgatgtcattttccaaaaggctgtaattcttgccgccgtaagagaagggcgggatcttcgcgaactggaagcaaaatcgaggcagcttgcagaacgttttcaggcaagaatacatcaggtgcccataggaaacatagatatctcttcctctgatatccgccagcgggtcagggaaggccgctccatacgttacctggtccatgacaggctgagggagtatatcgaagaaaatcagctttaccgggattctgcctgtccgggaaagcaggagaacagacatgaataaagatacgaaacagactcagcaaatcttgacgctgcgtaaggcaatggccaaggctttggaggaaaaaagatacgagcatactctgggcgttgcttataccgctgcaagtcttgccatgtgttacggacaagatgtataccaggcccaggtcgccggacttctccacgactgtgccaagaattacaccaatgagaagagaatcagcatctgtaaaaaaaatggaattcccataaatgccgcagaacaaaagaatccgttccttctccatgcaaaggtaggcagctttcttgcccgggagaaatacggcgtcaatgataaagcaattctggatgcgatcacctatcatacaactgggcggcccaatatgagcacacttgacaaaatcatatatattgccgactatatagaaccgggacgccgacaggcgccgggacttccggaagtccggcagctggcctttatcagcctggatgattgtctgttccgtatactgaaggataccctggattatcttcatgcgtcgaaaatggaaatagacatgtcaactcaacagacctatgattactataaagcgctccaatgcgaacagaaaggtggagaaatcctatgacagataaccgatccaaagaaatgaccagactggcaatttccgctcttgaggacaaaaaagcggaggatatcagtattattgatatcagtgaggtttccgttctggcagattattttctgattgccagcggaagcaaccgcagtcagatccaggcgctgaccgataacgtggaagagaagctgggacgtgccggctatgccaaaaaacagatagaaggatatgataccgctaactggattctcatggattatggtgatatcattgtccatattttcgacagggaaaaccgtcttttctatgatctggaaagaatttggagagacggaaaaagagtggatttggaagaattcaaataaaaaaaacgctatttatgttcaagtgtctttcaagagcataaatggcgttttttattatatacccggcggcatacgtttctatataatattatcggaatgtttcggtgtagtcccgaattttttcttgaaggctctggaaaaggtggaatagtccctgaaaccgcaggcataacaggcttctgtcacgctctttccgttttgtatttgtgttttggccgccagaaggcgcttttcgctgatataggagcctatggaatatccggtttccgccttaaaaagatgcatcagataagaacggcttataaaaaaatgatcagccagatcatcaaccgtcacttcttcatgcatgtgggaattaatataatcaataatagccgtgattttctcattggacacctcattttccagataatttacgtggttatttatcagggcccggttcagccagatcatgaattccaggaaaagaaccttctgatacagttcattggcatattcttttccggaaaaagagcgttccagttccctgcacacagcgaaaaggctgcttttttccatattgtctatacgcagtacgtttccatgctttgccttcgcttcccggaagcagcggcttaaatcatagctttcatccttatattcctgcataaatccggaagaaacatagatgataattctttcgtagggatgacagctgtgaatgacaggacgatgtatttctcctgcattgacaagaataatatcatagggctttaattcatatttccgtccctcaatggaataggttacatccccgctcaggaagaggacgattttatcaaaatcgtggtagtgataggaaaattccatttttttcatatcgttgagatgaaaaatccggaagtcattccgcagatatcctgtcttttcgtaattttccatatgcaatcctccatttctgtttattataaagcacaatttgcaagattgaaagcaccaattctgttttttgtattgaaaatgccatgtagaatataagttagtagaggaggcctgtggtatgaattttaacgcgctgcgctatgaagagcttacgcttaacgcatttcctgttttgcatacagaagtttatgatggctggattctccgtttctccggaggagaaggatatcaggggaattgtataagcccactttatctttccacaagagcttatgaagataaaattgattattgtgaaaataaattcagagaaaaaggccttccctgtgtttttaagatgacacctaacgttccggcagcattggatcagcagctggcaatgaggcagtacgagctggaagacaaaacatatattatggaatgcagtctcacttcggaagacagcctctcttcggaagaggcgcaggccctcccgtccggcagtcctacgggagaagacgatgctcaggaaaacaatattccggtaaaaacagaaatccgcctcagccgtgaaatagatgacaattggctggaagccttccttactttggaaggtatggataaagatatatgtccggaaaccgcaaggacaatgcttaacgcaatccgtaaacctgtgtattgtgcggctttatatgaaaacgaaatatcccatggcagcaaagcggactgcggcagaattgtgggctgcggccttggtgtggtggaagataataaaatcggtatttatgatatccgtgtggaaagcagcttccggcagaatgggataggagcacgtatctgccgggccatcatggacgagggaaaaaaggaaggagcccaaaaggcattcctccatgtatccgcttccaaccgtccggcagtcaggctttatcaggggctgggatttgaagaagcttatacttactggtatcgtgtgcatacggtataaatgaacggacattttttatctgaaaaactttttgatattggtttattcttcctgaagccgggaatacttatggtaaaacccggaaaggaaaaaattgcctgtatgctgagaagttatcatcttacccatttatcggatgccggaaaggcagaaaaaatccttcatgaaatggatggtctggaaggaatgcattccgcaagaatttcggaagacctgaaggaactggatgtggatgcggaagaaggaaagttcagctttatcatggatcatacggtaaatatctgccgcaaaatcgcagatgaatgtgaaatctcttttatgttccgttcctgagagtgccgccgtgatgcggcactttctccgtccggattatctttttacatattgtcagatctgaaaacagcctgctgtgtgaggttatcctcgtccacagcaggctgtctgttcctgcgggcttaaaaattaatgataaattcggaatacaccgaaaacttttcctaaaatcttacagtcattgacgatgatgggatccatgttatcattttcaggctggaggcggatgtggcctttttcacgatagaaggtctttaccgtagcggagtcatctatcagcgcaactaccatatcgccgttcctggctgtggaacagctttgtacaaaaatctggtcgccgttattaatacctgcatttatcatggaatcaccgcgaaccttaagaataaaagaaggatcgcctcccggtatgaattcagccgggatcggaaaatagctctcaatattttcttccgcaagaatgggctggcctgcagcgacgttgccgacaacgggcaggctgatcatttctgttctcaccatctggaaactgtcgtcacagatttctatagcccggggcttggtaggatctcttctgatatatccgttcttttccaatgtctccaagtgggaatgaacagaggatgtggacttcaggtgaacagcctcacagatttctcttactgcaggcggatatcccctttccaatatttgaacctttatgtattccaggatttctttctgctttgcagtaatcttgccctgtgccatatttcatcctccttaaaatcccgatagtgtttttttaagtatagcatagggagttttaaaaagcaaacatatattccgaataactgttcgatttttgtcccatttttacgctgatactattgacaatcgaatctatgttcgatataataaaaagcataaagaacgtgtgttcgaatatgtctggagggcggaaaatgtttgaagaaagaatcagattgaataaaatcagaagagagagggaacggaagcgccatatcctcatttttatcatttccgcctccataacaatattcctcacaattgcaggaggcagttttatttccaaagcacagggccccgatacgcctgtctattacaaatattataccagcatccggattgaagcaggtgataccctgtggtcgcttgcggatgcctatgccgatgagaatttcaaatccaaggaatcctttattaaagaagtggtcagaaccaatcatttactggatgataatatctgtgagggtgattatcttattgttccgtattattcagcagagttcaaataataagaggaataatacatactgaatggggaataaggaacatatgttccttttctataaacttcacacacttaatttccagaaaaccaaagggtttcttaagaaattctttggttttttctgtgcccattttttagctttcagggatattctattcttaaacctgattgcagctgtcttaaggatttttaagcaagaaatcctcaggctgtattacacgctgaatgatctgttccttgtttttatttataggaaaaaaagaggaaagtatgttataatactacaagaatacggccggagatgccgtaaattacacatgacagcagagggaggatgttttaaattggaagcaaaccgtattttagtagtggaagatgacaaggatatcagagaaggaattgaaatatatttgagaaaccagggctatgtggttttccaggccggggacggagtagaaggtttacaggtcattatgcaggaagagattcatcttgccatagttgatatcatgatgcctcgtatggatggcattaccatgatgatgaaggtccgggataaaggttatgatttcccggttattatgctttctgccaaatcagaggaagttgataaaatcatgggacttaatatgggtgcagacgattatgtgaccaaaccctttactactatggagcttctggcaagagtcaattcccatctccgccgctacagcagatatctggatgctgtgactaaagcggcagagccggaaaatgatacctgtcactgtctgggaggcattgaggttaacgaagaaacagttgaagttttcgtggatggaaaccctgttaaactgactcctatagaattcaagattctgcttctcctcattaaaaacccgggacgggtattcagcgcagacgaaatttatgaacgtatctggaatgaaaaagcgattaatacagataccattatggtccacattcgtaaaatcagggagaaaatcgaaattgatccgaaaaatcctaaatatttaaaggtggtgtggggtgttggatacaaaatggaaaaacaataaaaacagttcctttttactgccggcgatagctatcagtgctgccgtcagtattcttttcatgtctctttttccattgtttcagaaaaaggcagaagagagttatatcgatcctcttaccgaacaggattttatcagtgatttatttgctgtaaatctggttcagtataaatatctgcgggaaaaagcagatcagaagcaatacgaatattccgatctttatctggaaacgaagatccagaatacttacaaccgcacagaggatgacgaatcggagtcgttttccgactcgtatacggatatggcaatgcagacatttctttctacccagagagaatcgattaacagccagtgtatgcagtttgaaggcatgctgtcttctctgggcgaaatgatggattattatgtggaggatttaaacagcggtacaatcctttcaaacagcggaaccagtctgcctgatgcgctgagcgagcagcaggcggattctgataaaaaatcagagtatctttattatctgagcctgcagtatgacagtgccggcaacatatccaatgtcaacgtgaggtgcagggacaatgccaagcagttcttaagccgtgtgcagaatgccggtcatgattttccgttaaagctgcaggaagatgtgccatccggatatacctataattatgaagctaacggacgcatggcggattacacggtttatgatgaatataatgatatgtttgcggcaggttccatccatcttaccctgatggcgccttccaatatgagggtaatatacggtctgactcaggcccagtatacggaactcatgaagccggataactattatgaatatatgagcaatttccaaagtcttcattttgcaggcagaaacagctattatcaggcagggattgctccggcttatctactatttcttctggctgctgccgttatcgggttctttctgtgccggaaacggattctgcacaatgaggaagctatcaataaaatcggccggattccgctggagtttacagcagcggcagtcgtcttactgtttatggcatcatcacaggtgattcaatttgtatatgaatttcagaacgatctgttcctgcgtaatgtcagggcgggaatagggctggatgggaaactcggttttcttcctctggataaaaccataatgtttcttctgttactgatagtttttcttcttgccttcctgataggaaccaatctttcaggcttcggaagaggttatctgaagaaacacagtctgatctgcagatattggacgcgtatcgtcgggaaagtacgggaagtggtgcacgatttttatacagatctcgtcacttatgatatcggtaccgatgcaaacaggatcatactgaaggtcattgccgtaaacttcggcattctcctgataatctgctgcttctggtttgccggaattttcggcctgataatttattcagtcatcatatattttatactgaagagatatgtaaaggatatccagtccaaataccggaagctgctgaacgctacgagctctattgctcaggggaatctggataccgcgctttcagaaaatttcggtatctttgaaagctataagtcccagctgtggcagattcaggcggactttaaacgtgctgtaaatgaagaagttaagagccagcggatgaaaacagagcttattaccaatgtttcccatgacttgaaaacacctttaactgctattattacctatattgagctgcttcgtgatccttcccttccggatgagaagagaaaagagtatctggatattctgcagcgtaaggccaatcgtcttaaagtgctcatagaagatttgttcgaaatcagcaaagccagcagtaaatccgtaacgcttcaaatcgtggacgtggatatctgcaaccttctgcgtcaggcctatctggagcaggatgacaggatttcctccgcggggcttgattttaaattcagccttccggatgaaaagattattcttcctttggacagtcagaaaacctaccggatatttgacaatctctacagtaatattgttaaatatgctctttcgggaacccgggtttatattcttctgaagaatgaggcagactatgtacaaatcgagctcaaaaatatttctgcaacagaactgtctgtagctgcggaagagcttacggaacgttttgtacgaggcgatgatgcccgtaatacggaaggaagcggccttggccttgccatagccaaaagctttgcagagctgcagggcggttctatgaaaattgatatcgacggagacctgtttaaggtaatcctgcggtttaaaaagaaaaatacggacggtgccgcttccggcgaagaaaaggctgcagcgcagggcgttacaatgacgttcggagacaaaaacggaaccgcacaacagccgggcagcggattttttcccggaaacaacggctattatggcactcccggctatggaacacagaacggcggtccgcagggaaatggttacggaaatcccaattattacagcccccgtcccatgcagcagggaaatacggggcggagcttcggtactccttatagcaataactacggaggctatcccggaaataatacagttcgccccaattatccttaccagccaaacgtacccaatatggactggcagaatcaaaatgtcccatatcctcaggacaacaggatcataccttccggagtacctttaaattccggaagcactcagggaccggagccgcctcaaaagaatacgtttatgaaaaaaaggccgaaaagggaacgcaggaagaacaataaagaggaatagcttgaagaccatattattattggaagatgatgaaaatctgaataaaggcattgccttaaggcttcaaagggaaggctatgaggtatttcaggcctttactgtaacccaggcaagagaacttttccgggaaaaggaaatatcgctgattatcagtgatatttcccttcctgacggtgacggtatttctttctgccgggaaataaggaaaaccagcaatgtctatctgattttccttaccgcactgaaccaggaagttgatattgtaaacggctacgactatggagcggacgattatattacaaagccgttcagtctgatgatactgctttccaaggtaaacgccctgatgagaagggttgagaaaaaggattcctaccggctgcgatccggcggtatctgcctggattatcatgaaatgaaagcatataaggacagcgaaccgattgttctgacaaaaaaggaatggctgctgctggctttttttctggagaatccccggcagatactcacaaaggagcagcttttagaggccgtatggggccaggacggacagtttgtggatgataacaccgtaccggttaatatcagcaggcttcgaaacaaaattgctgccgaagagatacagacagtaagagggatgggatatatatggacaaaagaagctgtaaaagaagcctgagctatgccgggcttctttttatactggtactttttataattttattcctttctatgggatgggagcttcagaaaaaggaatatatgcttttaggctatatggccgccacttatcctgaacaggaaagtgaacttctaggagcggtgaatgagccggaacgtcattactctgatatttactatgaaaaaggccgggctttggaagaaaaatatggatttgatacaggcagcagagatacctcgcgccttatactccgttattttttcctgttttgtggcgttacctgtgctgcaggccttctgtttctgtatgcggatatacagagccgaaaacgctgccggtgtatggaagaggattacagcagcctccttctgttaacagaagaaaaggaagcgaaaaatgggcttatacaagaaaggctgaaacaagaggaaggaaagacaaaggaactcataaccgatatttcccatcaattgaaaaatcctcttgcttctttgaaaatgagctatgaactggctgataccggctgtctgacatcggaggaaaggcagagtttccttcagcagggacttgcagaaattattaagatagaacatctgctggatggtttccttcagatatcccgtctggaagcggaaatgatacatctggagcctgtggcagcaagcctgaaaaataccattataagtgccgtaaacagtatttatatgaaggcttatcaaaaaaacatttccatagaattaaacgagtttaccgatctggaaattcctcatgatccacactggactcaggaggctctggtgaatgtacttgataacgcagtaaaatattccttaccgggaagccgcattgaaatacgggtaaatcctgctgtaagctatctgtttattgaagtggaagatgagggtatcggtattccttctaaggaatatacccggatttttcagcgtttctaccgcagtgacatccccatggtccgaaaggaagaggggaccggcgtaggactttatctcacaagaaagatactggaagaacagggcggaagcatacgggtaaaaaaggggaaaaggggaagcatattccagatgacactgccaatgggatacgttggccgcccttccggtaacgtataaagagttttcttacaaatctgttatcttttctgcaatgttcctgtaagagaagcaggttatcattgaattatcaaaggattacagaggaaaggaatactttatatgaaaaatatgacttctattttaaacacgcaggagcttgtcaaacattatggttccggagagagtgtggtaaaagctgtagatcatacctccctggaggtacgacggggtgaattcaccgccattgtcggccgttccggatcaggcaaaagcactttgcttcatttgctgggaggactggaccgacctgattccggtaaggtctttattgagggaaaggatattttttccctgaaggatgaagaactggccgtattccggagaaggaaaataggctttatttttcaggattacaatctggtgccttctttgaatgtatgggaaaatattgtgctccctataggcctggacgggaaaaaagcggatcgggaattcgtaacctcagttattgagagtatcggtatagcggataaaataaaggctcttcccggcaccctgtcaggcgggcagcagcagcgtgttgccattgccagagccctggcttcacgtcctgccattatccttgcggatgaacctaccggcaatctggattccagaacggaaatggaggtcatatctcttttgaaatcctgcgtggctgattactgtcagaccctggtcatgataacgcatgatgagactgtcgcgcaaatggccgaccgtattctcatcattgaagacggaagggtggtggcaaatcaatgaataccattaataccacagcctgggcaaatctgaaaaagaataaaggccgtaatattcttacgggtatagcaatactgctgacgacttttcttatctttaccattaccacattgggcagcggaatgatccgtctgcagtttgaggctgccaatcagctttatcctgcctatcattttatgtatcggagcgtcagcgaaaaaacagctgaggatttgtctcatcatgcggatattgcagccctgggtcttcggcaggatacggcggagataatactggaaaataccagatgccaccttatttatctggataaaaccgggattgagctgggaaagcttgaccttgaagacggccgttttccttcatcgggagatgacatggcaatttcggaagggatgctgcaggaacttgggctcagcgcgaaaataggagacactgtaactctcagctttcagccattagaagccagcggcctggggtatgaacagcagaaaaccttcaccatatgcggtattcttcccacccctgaagcagaagatgatatcgcttactattctgctttggtttcccgggatttcgtagaagaaactctcagggaacccgatcgtttatacagaactatgatccggctgcagaatcctgaagatatgacaacaaatgaaatcctttataaagcagaatccattgcccgcactttttccatacccgaagagaatctttcagaaaatactgcgtatctggtggccaattatatcgaccctgccttttatacaacgcttattggtattctcattgtggtagtgctggcaggaatcattaccatttacagtatttattatgtgtctaccatgtacaaggtacaggagtacggaaaattaaaggcattgggggctacacagaggcaggtgcaggccattgtattccgggaaggaatctttacggcagtattcgctgttccgccgggaattgtcctgggaatggctgcttctctgagcggtctgtccttcctgctgaacagctttgcccgtgatgatcttttaggcaataccctgaaggacatatacgggaacggggagatctctctgtttcagccctggatttatatttttgctatcattatggcattatgtacaacggcaatatcccttctgcgcccggttcatattgcaggcaggatttcccctgtggaggccatgcgctatgatggtctcggtgtgtctcccggcagggccaaatccagaaaaggttatgatgatgtcagtctgttccggcttatgaaagcaaacctttcacgcaataaaaaacgaactttgataacacttgtatccctgagtataacaggtattctttttcttggggtttccactattttatcctgtgccaatccggaggaaattgcccatgatgaaattctgtatgatctggatctttccatttattctgtcagcggagataggatgcggcctgaatacgactggagaactatccagcagcagaatcctctggatggcagcctgatgcttcgtattggaaatatgcccggtgtctcttcggttatcagccatcagaataccagtgtgcttctgcaggatgtatatgatggggattcactcaggagaacctccatttcaggaatcccccgggtactggccgatacaatggaagcttctgtcatagagggaaatgttacctatgatgaactgcttgacgggaacaagataatcctgaataagaaggcttttatatggtcgccggactggaaggttggaagtatgataaggatgattgtccaggacggggaaaaagaaattccgatggaattccaggtggcggcaatagcggatcctccggtcagcctatatcattattcggccttcatgcttccttcatccgtactggaagaaatatgcagcaataatcaaaccaatagtctctccatagcggttgaaaaagaaaagcttaacccggtggaggagagcctgagggcaataacagatgaaaatcctttcctgaaactgcatacctttgaggaaacgaagaaggaacaggaagaactgacagcttttttatctgccgtatgttatattttcctggctgttctgggaagcatctgtattatgaatctgatcaataccatggtaaacagtgtttatgtacgcagacgggaactgggcatgatgcaggctctgggattgtcggaaaaacagctgttcacgctgtttcagatggaaggccttttttatacacttggaacactgcttttatccctggtttttggcagtattacgggttacctgttcttccggtgggccagggacacaggcttcttaagtattgtcagctttcattatccctttgcacaaacgctgcttttattcctcgtcattatgatcgtacaatttggactgacatggatactggcccgaagctttcggaaacagagtattatcgaaagaataaaatttagtgcctgaagacaaaaaagggagctacggctcccttaatttgacggcttttgccgcttttcgtttattttcatcctgcatggcagcatagtgctttctggtggtatttacatccttatggcccaggacatcggccacaagatagatatcccctgtttcccggtacaaattcgtaccgtaagtgctgcgcagcttatgcggggtgatttttttcatggaagttactttagaggcatatttcttaaccagattctcaacactgcgaacggtaagcctgcggttctgcatggagaggaaaaaagcattttcatggccggagagaggaataatccgttcccgttcctccagataatcctgcagggccgcggaaacctcctctccaaaatatacgatatcctcatacccacctttcctgcgtactttcaggcgctggttgtcaaaatccacatcctggatatccagccccacacattcagatacccggataccggttcccagcagaagagtgagaagcgccaaatccctcaccctggtcttatcatgataacgctgctcgttcttggttagcttgtttccttcctccacttcatccagaagaaccgctacttcgttaggctccatcctgacgatttccttttcgtgaagcttgggaagcggaacaaggactgcaggattgttctcaattagttcattccggaagtagtaattgtaaaagcttctgagagaggccagctttctcttttttccccgttcatcattggtgtattctacgccgtccttaacataataggagagatattccatatactcctctatgtcctcccttccgatttcatccaggatggaaagaggaaagtctacaatatcctttttacggtataccccattggtttcatggataaactcaaagaaaacctttaaatcataggcgtaggctatccgtgtccgggaggcggtcacatcctcgatcccgcggaaaaactgtttgcagaagggcgggagaccggccagcagctcccggagcttcagaatattttttttattcagttcatcatggtaatttttgttttctgccattttaatcctccccggcaaaaccgttccattgaaaagtattattatctgcgcagggtatccggcggcggccagcctgtcatattgccatcctgtattgcggtaaacatccgttcctttacccccggattctcctgattcagctttttcaaaagctgtttcacatattcccttttggtatagccgtcggcagggcaggggcttttaacaacaggcacctggtttttattgacaaatccgataacatccgcttcattcatatacatcagcggccgtactaccgtcagatccattctgtccagataggttaccgggctgaaggtatggaaacggccttcataaatcagggacatgagcattgtttccaccacgtcatccttatgatgagcatatgccaccttattgcagccttcctttttaatggcttcattcagggctccctttctcattttagcacaaagagagcagggattggtttcttttcgctgttcaaatataatattggcaatatccgtttttacaatggtataagggatctgcagttcctgtgagcaaattgcttctatacggcttaaatcgagattgccgaagcccagatccacggttaccgcatgaatatcaaaatgtttcggataaaaacgccgcagtgcgtgaagcgcatagagcagtgtcagagaatccttgccgccggaaatcccaacagcaattttatccccttcttcaatcatgtgataatcgtccaccgctttccggacatagcttaaaacctgttgcagtctcatatgtaatcctttcttctatacaaaatttgctgctttataaatcctaaatagatattatacaattattttagaataatttcattaattttgcttaattttttaagtgcggtggtatataatgttcttactgacctacataaatggaagcaaaacattccaagtaaaaggagaccattttatatgaaattccgctgggacaaaaaatatctttattggggcatcacggccctccttgtcataggggccagtatatgcctctttttcttgatgttccggggcgccaatttcaaagacggcgtggcccaaattatttctattgccatgccgattattgatggcctggttctggcctatctgctcactccggttctgaactttatagaaaagcaagctctcaggcatgttttcaaaaaaggacgtcaggccctgacagataagcagaaaaaatatctgcgtatgtccgcaatagtactgacattgctgtttgtggttcttattatttacgcattcagctccgtagtgctcccgcagctgttcaagagcattcagagtattgtgttccaattccctgtttatgtaaataaccttactgcatggcttcagaaggttctggcggataatccggaagtggaatcctacattaatgatctcatcaacacttatacacctgaactcagaagctggatgaacgataccctgctgcctcagatgaacgctgtcctcaaggtcgtttccaactatgcttttaacgtacttaaggcattgtggaacatgattattggcctgatcatatccgtatatattatgggaagcaaggagaagttcatcggccaggcaaaaaaagccatttattccgccatggatatcaagcgtgccaattcctttattgaagacattcggtttgtacaccgtaccttcggcggatttatcagcggtaagcttctggactccttacttatcggaatcctctgctttgccggaacaagtattatgggaactccttatccggtgcttatcagtgttatcatcggtgttaccaatatcgtccctttctttggaccttacctgggtgcaattcccagcgcattcctgatattgatgatcgatcccatacagtgcctttattttcttattttcattttggttctacagcagtttgacggaaatatactcggccctaaaatcctgggagactccaccgggctttccagcttctgggttattttttccatcacaattttcggcggttttatgggtgtgccgggaatggtaatcggcgtaccaaccttcgcagttatatatgctctgtgcagacgctggattaaccgcaatctggccaagaagaagctgcctacggaaaccgaggaatacaaggaactgggccgaattgatgaaacgagcaaagagttcattccttgtcatccggctgaggaatctgaagaaaagcagtctaaggaagacaaataaaatagaacaggagaagcagtccccatgaagtttgttattcaaagagtcagccatgcaagtgtcactgtagagcaggaaattgtaggatccattcaaaaggggtttctggttctgattggtgtaaataatacggatacggagggcattgccgacaaaatgctccgtaaacttctgaacctgcggatattcgaggatgagaacggcaaaacaaatatgtcgttgaaggatgtaaacggcagtttactgcttgtttcccagtttaccctgtatgcggactgtaaaaaaggcaacagaccgtcttttgtaaaagcaggctctcccgaacatgccgaacagctatatgaatatataaagcatgcctgtaaaaaggaaggttatcctgtggaatgcggtatcttcggagcccatatgaaaatagaacttgaaaatgacgggccatttacaattgtgctggattctgatgagcttatgtaacagcattctgaaagccacccggcatgagccggacggacgcaggatttataaaaaaaggaggcgtaaacgacagctttaaaatactgttgtttcgcctcctttctgttttgcatcatgttattcaaaagctattgcagtgcccgaagtatccttccatctctttaacgttggcagaaattccataagcgcagatcttgcttcctgttctgttaactgcagcccgacagatttattccattcatccaaatcccgcagattcagttcaatcatttcctccatagtaatatcctgagtgaattttccatgctgataacaaaaagagcagtattcctctgatttgctgccatcgcattctgttcctttatcactgtccttttccagaaccagaccgcagctctggcattgtcctaccgtatgtcccagcaaataatctaccgacacctcaaaggtttcagctattaatttgagtgtatctatattaggaattgtgtctccgttttcccagcgggaaacagcctgtctggttactgataatctcctggcaaactcatcctgggatatattcagttttttccgtaattctaaaattgcttccattgtctccattcatacattcctcctttttgtaatcttagcatagagtataaaagaaatacaagcaacgcgttgttgcccctcttgttgaaaaggaagtttgtcatgtgcttttaagtcctgtataataataaaaggattccatacaaagagaaaaaggggataactgcaatgtctattacatcaaaggcaggtactgctgaaaatacgaagcaaacgcctgctcacagtttagggcagaacatcacatatatgatatcacttgcgtggagacagcgccgtagcgtaattgggcttactcttataatggcggcagctgcgatcctgctcagtcttacacagctttttatagtaccgtctatactcggagcagtcgaagctaaagtttctgttgcagaactttctgtaatcatactcttgtttacgggagcattgatattcctcagcgcagctcaggcatatctggcatcctgttcacagtttgggcgtattgaagtccgccttaccatcggagctatgatccaaaataaggtgctgaccatgtcatatcccgatattgaggatccgaatgtcaggaagaaaatggataaagcttccatgcttgttaccagcaactcggctgccactgaagctatctggacgacattgatgaatctgttaaaaaattcagtggagtttattgtttttctttctttgcttgctgcattgaatccgttcatgcttcttgccgttttggtcactgccattgtcagctttttagtgagcaattatcttaatggctggggatatcggcatagagatgaagagtcggaatactcccggcatatgaattatctcagcgaaagctccagggattacacgcttgcaaaagatatccgtatttttggaatgggcagttggatagaagatgtatacgacagcatgctgcgtctgtatcggaactttatcgcccgcggagaatgtgtctatatttggggaaatattatagatgtattactttcatttatgagaaatggtattgtctatcttttcctgattggagctgtgattaagggggagatgtccgccgcgcagtttgtgttgtactttaatacagtgaatgtttttaccagcggcataggcaagattatgaccggcctttcagttcttcggaaacaaagcctcgatatctctgcagttcgggaattcctggattatcccgaaacatttaaaatggaggaaggtatcccaatcactccggacctgcatatcccttatcaaattgaactgcgtgatgtttccttccgttatccgggggctgagaaggatacactcactcatatcaacctgatgatcagaccgggagagaagttagcaattgttggtctgaacggcgcggggaaaacaacactcgtcaaactcatatgcggtttcctggatcccacggatgggaaagtgctgttaaataatacagatatcagaacatacaatcggcgagattactatcggcttttttccgccgtattccaggacttctcggttcttgatgtgactatcgccgagaacatcgcacaaactgatgaaaatataaatacagatatgatgaagcgatgtatcggccaggcagggctcacggagaaaattgacagcctgcctgatggtgtggatacacacctgggcaaggtttttgaagatggcattaatctgtcgggaggcgaattacagcggctgatgctggctcgggctctgtataaaaatgctccgattatcgtcctggatgaaccgacctccgctcttgatccaatcgctgagagtgaaatatataacaaatacagtgaacttacggatggccgtatggctatttatatttcccatcgtcttgcctccaccagattttgcgaccgcataatcttgatcgcagaagggagtatcgacgaagaagggacacacgataagctaattgcccggaagggacattatgcggatctctttgagattcaaggcagatattatagaaaaggaggagcggactatgaaaaagaataaatcttctgtttcttttaaagaaacggttcgcttcgcactccgcggatttaaggtctggtggagagaaaatcctcaaatactgctgtccgtactgatatgcggggttattgacgcacttacgccttatgcagatatttggctgttggctcgattgatcgatgaaattgccggagggcgtgatccgcagatgattaaggtatatgtgctggcattgatgagtacaacagctatacttacactgctctgtgcaggattgacccgatggaagaatgttcagttagcctgtctttggcatacacagaataaagtgttcatggaaaaacttctatcgatggattttgcagatatggatgacggccatgtacaggaacttcgttcacggatatggcaaaatacagactcaggaggttggggactttataaactcatatatagttttgatgcgattatcagatctgttatgtctattatcggtgcgctcctgctgactgcatcgctattcatactgccggtcacagcaagcggcggattaaggatactcaatcaccctgtttttatttttcttattgctgccgtcatgttcggcatcacatttgcagcaccattgttagctgtcaaggcaggttcctactgggtaaaatatgcggatgaaaaccaattgggaaatcggcttttcggattttggctcggcaatcttgggaatgaccgttcgaaggcgctggatgtacgcatctatcgtcaggatattctgagcagaaacaatttgaaaaaatataacccgtttattcctacctcaaaactggctaaagcatcaaaaggacctatgggaggataccgtgccctgtccggagctgtgtcgcaggtatttgtaggagtcgcatatatctttgtatgtctgaaagcgcttggaggagctttcggcataggttcaatcgtacagtacgtgagtgccattatcgcattatccggcggtttgtcgatgctgattgagacattaggtgatttaaggaataatacctcatttttgcgtaccgtgtttgaatttttagatctgccgaacaaaatggagaaaggggatacgcgtgtcagccaaaacagcgacacaggatatgaaattgaatttcgtaatgtctcttttaggtatcccgatcaggaagattatgcactgcgcaatgtatcaatgacatttcatgcaggacagaggctggctgtagtaggcatgaatggaagcggaaaaactacttttatcaagctgctgtgccggctatatgatccgaccgaaggtgaaatactgctgaatggaatcgatatacgaaattacaattatcacgaatatatgcagctgttttctgttgtgtttcaggatttcaggctgttctcttttgaactgggtcaaaatgttgccggcagcatgaactatgactgtgacaaagcagttcagtgtcttcgggatgcaggcttcggaatacgccttgataagctgccgaaagggcttgcgacggcattatataaggattttgatgagaaaggtgttgctatttccggaggagaagcacaaaagattgcgctagccagagctttatataaagatgcgccatttatcatacttgatgagcctacggcagcgcttgatccaatcgcggaattcgaagtatacagcaggatgaatcaaatgataggagagaagtcggccgtatttatttcgcacagattgtcttcctgccgtttctgccatgatatcgttgttttccacaggggctgtctgattcagcgcggcagccataatgtgttggtgaacgataaatccggaatgtattacaagctgtggaatgctcaggcacaatattatgaggtggaagaagaatgagaactgcctggtctttcatgatgaggaaaaaggtgtttgttaatttattaacattcgaaacggaagagtaaagtatttatttttcatgtatgtaatctatttatgggttattaattaagtaaacgtgataactatttcttttatttgtatcgtaaaattagaaggtggtaaaattatgatttagattctcagttttattgttattaggtataatccaggtataggcttatcaatgattattgggatagaacttaaatgtaaatctattaattaagagagctatactaaattgtctgacaagactgagggaatagattatttaagagaacgtggtttttaaccctgtttcccgcggctcctgttttcccaggcgtgccaaaatgggagccgcgggaaacatccacctccaggggtcattttcagcccatctattcgttaaacttgtgttttgcgaatagtccttagttcatgctatgatgccattctacccagttcctcatacagcgcaaccagaccccttacaaatcatcccgtcatacgtcaatagaattaaggtcaaaacgctacattaacattgaatttcgcttcctgtattccctcggagaacagccttttatccggtgaaacaccttggaaaaataattggagtcggcaaatccaactctcagtgcaatctctgtgagactgtctttgccgtccaatacatcaggaagactctgttcgatccggtacttcagtatataatcaaataaagattccttcatataattcttaaaaatcctgcagcattcacttttacatatatgcacatgctgtgcaatatcttccagttccagctttctggcatagttctcctgtataaaagaaagcatacagcgaatccgctcgtaatttttttcatctatactcctgctttctgttccttcgacactgcagttctccagtataagaagccatatgtgaagaagctgttcctgaatccccagctcataaaacggacggcggttcttactttcttcaataatattgcggaggccttccacaacttcctcctgccagatttcagaagagtcaaaatgaatggcggccaatcctctgtgatgaagaaccggagccacatatttttcctggataaggcttccctcgtacccatacagcagccttggcgcaaaggtaatggaaatgtattcacaatccgtttcatccgccatatggccggaatgcagcgttgaggagttgccaaacaaggcctctccctctttcataagaaaacaccggtcattaacctgatagatcatacggccttccgtgataagcgtaaattctatttcgctgtgccaatgccacagaaaagaacctgtatcgtaaccggacagactttcatagctcaccagaaagggaaaaggataactgccgtgttccttaagttctttttgagagggattcgttataatctgcgtctttcctgttttcgatgttttcataatctcccctcctctttctaagtaaagggtatcatttcttaattataaatgcaattctttttatataagaaacgcaatatattccctatactgcgcatgattattaaggtcttcccccataaatcagatataatgaatttatcagagacgtctcggtaaacaatgaaataaattgagcctgaacaaatgaaaggggtaaataatgcttaagattactgacacattcaaacaaagtctcttggaagtctatggagaaaaggaaaacagctgtgaacgtttcatggcactgaccaagaaatacaaagaatattttcatatggaggagccagaatattttacttctcccggccgtatggaactcatcggcaaccatacggatcataatggaggaaaggttttggcggcaagtatacagatggatactatagcggctgcaggggcgaaccggacagaaacggtaactattttaagtgaagggtatgaacagccttttatgctgaatctggaggagctggagaccattcccggcgatgaagggactctttcactgcttgccggaatctttcagggatgccgggcctacggctttcatgtacatgggtttcaggcctgcatttcaacgaatgtactcagcgcagccggcgtcagttcttccgcttcatttgaaatgctgatatgtgccattattaattattacttcaatgaaaataaaatgtcctgcattgattatgcgcgcataggacgttacgcggaaaatcattactggaataaacaatccggattgatggatcagcttgcctgtgcagccggcggcatgatttttctggatttttccgactctgaattaccgtgtgtggaaaggatggaatcaaaatccatattggaaggctatgatatcattttggtaaacactgggaaaggacacggagatttaagcagagactattctgaaattccgtcagaaatgaaaaaggttgctgcgcagatgggaaaaacagtgctgtcggaggcgtctctcccgcttcttctgaaaaagcttcccatgatcagggaaaactgtggtgatcgctccttccttcgttctcttcatttttatgaagaaaataatagggtggataaggccaaagccgccttaattaacagagatacgaaagagctgctggagcttataaatgaatccggcaattcctcctggaaatacctgcagaactgtcatatcccgtctgataccacagaagaaagcgtttgcgttgccctggccctgtcggagctgttcatccaaaataccggacggggtgcctgccgtgtgcatggaggcggctttgcaggagtgatcctcagtatcattccgtcaggggcctcacaggactatatccgctttatgtccgagtatatgggcggaaaaaatatcttccggatgtctctaagagatacaggagccatacatttgaaacagtaatagcctatcagccctatggaaaaatttccggttcatcacggatcctgatatccgcttatatccccagcctgtcaaagcattccttcaaagccatcgcctcttccatcgtgttgtgccagccatatttttttaaatccacttttccgtccttcacttctaccccttccccttccagcagccatttctgcatgtcaggggtatcaaaagcaggggctccggtaaggagtccctgtgaatttaccacacgatgggcgggcagcttctctcctgccagtcctctgttcaatgcatatcctacctgcctggagttcctgggcctgccacatagaagcgccagctgtccataggttgccacctttccaaaaggaatcgcttttcctgcaagggctaatcttctgtaaaaatccatattttgttatccttctctgtcagtaaatagtgcgaaaatacagcaggctttttcggaatgcatgaatccccagtaaatatatcatcgtacatgccgtaccgagggagaaaaaggtataaagcagagacttttgtttccttgccatgaattactcctgattgaaatttatggttaattgtcatctgcagttattgttccccggacaataatattcatgttttcttttaacagcctgtttttaccagtatagtttacataatatttttatgtaaacctacccgttaataataagaaagagaagcttctctaagtgatccgcttctctttcttaagttccaattacaacacagcaaaattacggctcaggggttacgccgtttaaagcctcaaaatcttcgaccatctggactatcagtttcacagtgccgtcaacacccaggactgaactgttcagacagaagtcatagctgtctgcacggccccacttcttggaagaataataattatagtagctctgacgctgcttatccttcttggttatcatttcacgggctttatcctcagttaaattgtatttacgcatgatacgcttgatctttacctcttcgtcaccatagatgaaaagattgatgcagttcttaaaatcatgaagcgcataatctgcacagcggcctacaatgatgcaggggccttcttccgcaaccttcttgattgtatcaaactgcgcaagaaatactttatggctgatgggcatatccataaaggaagatgcattataaccgaaggaataggtgtccatgaccagattgtagaggaaggagttagtaggcctctcatcgtggtttttaatcatctcctcacaaaagccgctttcctttgccgcccttgtcagaagctccttgtctaaacatttaatgccaaaatattctgctaccttctcgccgatttcccgtccgccggaaccaaactgacggcctattgtaatgattgtattcatacaactacctcctttttaaaggtaagtaagctaccttttataaacttattatatagaaaaactgacaaaacttcaacgacaaaagaaaaaatctcctctgccggattaacagaggagccaaattatgctttttttcagctttgcacggcattctttccctcgaaaatcttctgcagaaaagaccgctttttttccgcagaatggctgcagatgatcttttgatcctccatgctggcaagaacaagctgtcccgtacagaagcctctcaacttaaaatgataatctttttcaaaagaataccgtttcacggcttttatggcatttttatccggcggatactgggaaatcagaataactgtgagaaaactgtataaatgtttcctgtcaggaattcttccatcctttcgtacaagcctgggttccatataatctgaaataacagtcagggcctcattcacatgctcctgcgttattttatccgatgtgaggaataaaacatgctcatagccggcagatgcccataatttcccgtttttttcagggttctgctccctgatatcggaagtaaaatacccgtatgcaggatattccttaccatcgatgtagtaaggcttatatatatcataggtttcttcatatcttaacagcaattgttcaagatattctgatgtttccatagcggccctcttcttttttattggatacggtcctgaaatacacttatctgggaagtgtctcgagcaaatgactgaaataatcaggcaaaggagccatggtttccacgtattctccggaaaccggatggatgaagccaagtgtcatggcatgaagtgtctgcccctgcagaacataaggcagcgaatatttcctgtttccgtaaaccgtatcaccaagcagcggatgcccgatggagtccatatgtactctgatctggtgggttctgccggtttccagacggcattcaatataggtataggcccgaaaacgctccagcaccttaatatgggtgactgcttcctttccattcctgaccccggccgccatctttttcctgtctgtcggatgccttcccacagggctgttgatacacagctcctcttccctgataacgccatggactatggcacggtaacgccggacaatggtatgatccttcagctgggcggcaatggacagatgagcattatcatttttacagataatcaggctgcccgtggtatcgcggtcaatacgatggacgatgccgggccgcatgactccgttgattccggaaaggctgccccggcaatgatacatgacagcatttaccagtgtcccgctgtaatggcctgccgccggatggactaccattcccttgggcttgttaaccaccaggacatcgtcatcctcatacaggatatccaaagggatattttccgcctcaatatccggttctgccgcttcaggaagggtaaaacagatttcatcctctgtacgcagcctgtaattggccttaaccgggatattatttaccaataccttctgctccttcatcattttctgaataaaggaacgcgacaaagaatcgataagtgacgccatatacttatcgattctttcatcttcatattcttctgtcacctgaaaccgaaataaatccggcatatgctatcccctactctttttcattttccggactgtcttcttcctttggaatactttgcttctgcttaaatgacaggaaacggaaatcttcatccttatatttattgctgaataaaatcaatatggctcctaccacacaggcaatggagacaaacatatccgccacattaaagatgggaaaatcaatcagactgatataaatgaaatccaccacataatccagtctgatacggtctatcatatttccaactgcccccacagccacacagtccagcaagatatgcaggacacggaatttgccgtcagaaggcatcttaatcagcgcatagataactgccgccagtataacaggcgtgattatgaggaaaaagactttggctccctgcatcatcccgaaagcagcgccgcggttttccaggtaccgcagttccaggactcctggtatcagggatacaggctggcttcccttcagataaaccaccgccagatgtttggtgaactgatcaagcagtatgcccgccagaatcagcaggatatccggcagccatatgattctctttggaatattttgtttccggttattcatgttcgtcctcttccgtaaaattaatttcgtcgatcgccgcaagaatttcttcctctgttaccgtagtatccagaacagctttgccgatcttctgaagaagtacgaacttaatatgtccttcttccatttttttatccgatttagtcagcgcaaggatctgttcccgatccaaatcatctacagaaataggaagattgaagggaacaaacatatccctgatttcgtaatactcttccatagaaagaagctctttcttccaggagataaaagccgcggccacacatccaagcgcaacacactccccatgggtaagggaaaaatccttggccttttccactgcatggccaatggtatgccctaaattcagcagggcgcgctcccctttttctgtcggatcattttccacaattttacgtttgatgtcacagctacggtgaaccatctcctccatagcatccggttccctgtcacagatttcatataaattggcaaccagccattcataatacctggcatcactgataagggcagatttcatggcttccgcgaacccgctgtaatactgacgtggctccagagtggaaagagtggaaagattcatataaacaagcctgggcatatggaatgccccaaccatattcttgtattgatcgaaatcaacgcctgttttccctccgatgctgctgtccacctgggacagcaatgtcgtgggaatctgtataaaatcaatcccccgcagataggtggcggcggcaaagccggtcagatcaccggtcactcctcctcccagcgctgcaaggcagtccttccttgtataatggttttcaattaaaaaagaatacaaagcctttaccgtatccaggttcttattctcttctcctgctgaaaaagtaaagatgtccgtatccgcacacacagaagaaactgctttttcaacctcacttgcataaagcgcacccacattggaatctgtaacgatacacagcttcttctgtgcaaaatccaacgccttcagttcttcagacagcgcctgaaaatccctttcaaatataatatcgtagcagggcttcttctggtaggaaaccgtcattctttccgacataatgccacctcgttctattgatatttttatcctgtatcccgctcaaaaagcgccgcctcacgacgacgcttctgaaaaacatccttctttgtcagctggtgaatccgggaacatctaccgaaccgctgaaaatttcctggaaatctccggaaatatctacactggcaggtgtaataataaatatgtactgggaaatcttctgcagattcccgctgattgcgaagcaggatcctgaagtaaaatcgataattctctgagctatatccacatccaggccttccagattcagcacgaccgttctgttggcaagcagcgtttccgttatttctctcgcatcctcaatgcttgtaggtttaatcacacatacctccatcccgttgccggcagtccggcggggctgtctcataggagttaccttgggggaagctttcttgggcttgtcttcctccataaatggttccgctttcgccttaggtgttatttttgagattttctctaccggttcatcatcgtcataataatcatcgtcgtcgtaatcatcatactcttcatcgccattcagtttcatataactcaaaaacttgtccattacacccatcgtgccaatctcctttatgattacctgtcaggtatcttattccacctgataggatctttcaccaaatattcctgttcccacgcgtacaaaggaagctccctcttcaattgccacctcataatctcccgtcattcccatcgaaagataatccatacgtacattatcaatgtttttgttagttatgtcaacatataactttttcaatgcactaaaaaatattctgttatcctctgcattttcgacaaaaggcgctatcgtcatcagccctctgaccagaataccgggcagatgggatatctcctgcaccagtccgggcgtatcctcaggggtgacgccgaacttgctttcttcgccagccacattcacttctattaaaatgttaacgattatcccccgctttaccgcttccttgctgatttcttccgccagacgcagggaatcaacactgtgtatcatataaaccttatcaacaatatatttgaccttgttccgctggagatggccaatcatatgccacctgatatcgtcaggcagctgttccgccttgtcaaccagctcctgtaccttattctctccgaaatcccgtatgcccagtgaatatacttcttcaagcataggcaggggctttgttttgctcactgcgataagtgtcacgtcactttccgctctccctgacctgcggcaggcttccttcatattttcctgtacctgataaagattttctttcagcatttctgactcctttcggacggctctattcaagaaattcatttcctgttacggtttccgcatccagtacaatacgatcaaaggcgcttaatccataagcggtattggacttgataatcgcgtactcatcattctgggaaagaatttgtatttccttaaaatctgcataccccttattaatattataaacgcctatgagggttgcgcttcgggatatggtatatttatctgtggaatccggcctgaccagattgttccccagctccagcacggaattatcaatataataatcatcttccgtttcaaaatatatggaggttgcgataaattccgtagaagcctctccgttttccgtataggtttctttaagaacaccgttctcactgctgttgccctttgtcacatattccttgggaaccaggaaaaattctttttccgcaatggcggagttcggaaccttaaggccctgctcgtcctttgtaacaagttcaatatcgatgtatcggtccgtacagaaggatatcatggaattattaaagtccagctttacatatgtattcccgtcctcattattgagtacattcacctttgcccaggaggtacactggtttttaaggaaccgcacctggacatattcttcttccagcagctcctgtgccctttccggatcggactggatgacaatggaccagttttcatctgtcgcgagcttatataaggtatcgccggaggctaccagctcattgttgatcagctgtcttttagagtaatcctccttatcgaacatatcctgggtaatttgatccgcagtaagggtttcatagccgtccgtagaataaaccacgataccggaaaccggagcgctgcacaatgatatcagagatgaccctgaaccattcagcgactgcaaatcctgaagcacattaatattggccagcttcagtgcagttccttccagagaatatttgaaatcatagactccggagaactgctttttctcaaatccgctcatatagcctgtaatttcacttttaatatccgccagattattatccgacaattgcgtatcatccgccttaccggcgtcaaacatctctttcagctggccgctttcatcaatgctgcataccagctttccaaagccaacccgttctccttctcgtgcataataattaatgtatccggaatcattgctggtgacaatcgtttcctctctcagcgcaattccctggtatacgttcccgatagaaagggaaccattcttcacttcgtaacccataatatgcttttgtgtaaaataaagaaaaacacagatgaccacatatacgaaaataacactaaaaataataatccccagattaatattcagcggttttctgtattgtctgatttttctattggaagatccgctttctctgccagccaatccacatacctccgggtaaaacaatatcaatattttctgtctgccgcattaaaaagccccggaaaacatccggggcctttttcctttatttaaagagatacaataatcttcgatttcaagctttccggcaactcttgctcatcaagggaaatgctgaggatgaaatctatccggaacatttcactgattttttccaattttgtgataacaggaaggatatcacaatcttccaaatgggcaaccttcaggaaactgtcaagaaacattttctcaagatcccggtcctgagatataataccgcagatgaatcccaaaaattcagaactgttttccaccatgaattcacttacatcaatcagtctgaccttgttattcaattcatacatgtgcttcgcacttttgtctaaataaacaatgtttccggagacctcttttacttcggtgtttactttatccaataattgttttgtcttgcctttcccctttttgcctacgattaactgaaccattgtaatccctcctaaagtaaattggcgcttataacgcctcttaaatatgatattattatagttgatatctgtttaaaaaacaacctttttaattaattacattcaaaagctctgtcatctccgtatagagaatttgtttctccttggaacggagaatcacggaaatataagggttgccggaggtgtctttactaagtaaaatcaggcagttcccggcagcattggtggttcccgtctttcctccgataatagtaacctgctccggagccttgaaattaccgttcaaatactggttcgttgttttcagggacatggatttggaatttccgtctttgtccatgtataccgtttcatagcttgtcatatgaataatttcattaataaggtcctgcttcaaagcctcattaaagattaagtaaagatcataagccgtcacataatgattgtccgcagtcagcccgtgcggattcacaaaatggctgttggtggctcctatagccagcgcttccttattcatcatttctgcaaaaccttcaatactgccgccgatatggacagcaatggctgccgcagcgtcattggctgaatgaatgagaagtgcgtgcagcgcctgattcagcgtcagctgatcacccggctttaagccgcacagcacagctcctgattccgttatgctggcctcgtcggtaacagttatcatatcatcaggatttccatatttcagcgctaccaaagccgtcataatcttggtgaggctggccggctgaagccgttcatggacgtttttggcatacatcacattattcttgttaagatcaaaaagcccggctgccgtagcctccgacatgtccaccgccccattctccgtacccacatctccgattaccacacagagatcatcagcaaaagagtctgcaacaacactggatacttcattgactacccggtagctggacacctcataatccggattgtaggcaaatggcagttcttctttcccgcagccggtaagggctcctgccggcagtgaagccaacaggcagatgaccgcagtcctggaaagaatttttttcagccgggaaaacaccgggcttccctgggctttcagattccgtttatttgtacatttcacgccattccaaatcccctctgtcaagtgatttgattaacagttctgcagtcgcaagattggtcgccaacggaatattatggatatcgcacagacgaaccacattattaacatccggttcatgagacttgggtgtaagcggatccctgaggaaaatgaccaaatcgatctgattatgctcaatctgggcgcctatctgctgctcacctcccagatgcccggccaggaatttgtggacattcaggttagtcacctcttctatcagccttcctgttgtacccgtggcaaaaagtacatttttggttaaaattcctctgtaagcgatacagaaattctgcatcagcttcttttttgcgtcatgcgcaatcaatgcaatattcatagcaaccttctcctatactagtataaattttttctctgcaatcgcacattcagtacaaatcccataccgataaacaaactgacaagagatgtcagcccattgcttacaaagggcagcgggattcctgtgttcggcataatcattgtggttaccgcaatattcataaagctctgaaagcctattactgcggccattccggaagcaattatcattccggaggtatccttggcggttctggcaatggaaatacactcaagggcaatgagcattaacaatacaattaccacacaggaccccacaaaacccatctcttccccgattacggcaaaaataaaatccgtttccggttccgagatgaaattgccgttctttactgacgctattacattattattcagacctttcccccatagctggcctgaacctattgccatcactgaattgagctgctggtaagcctctgcatccgcatatttctccggattaagccatgccagaatacgggtcagctgataattctgaatcagctgctgtcccggctgcattaccaaataaaaagcaaccgccagagacggaacaataacagctaaaacgcctcctatgatcttgtaattcaagccgcccacgaatatcagtacgcagaataaaatacagtacagtatcgttgtggacaggttcggctctttgtatacaagaaagatagccggcagcatcaatcccacacaaaggaaaagtattttgaatgtatttaacttttccttatatttcataataaactgtgcatagaataaaatcaataatatttttgcaatttctgacggttggaactgaaacaggtggggaatattgatccatcttgtcgcaccgtttaccttttcaccccagattaaaacagcaatcagcataccaatagaaaaaatatagtaaaaccagtaaagccttagcagctgggaatagtcaatcaatgatatgataatcataatgaccattcccattgccacgccggcgatctgtctttcctgcagagattccttggcgcttcccaccgccatgatacctataatggatatggcaagcaccagcagaaccagcttgaagtcgtaattccttagtttgtatcttttcagcattttttcctccaactgctttaaagagcagtttgcgcctgaagagcagtttgcagtatgtaaaagtctaattatgaaggtccagtatagggatatccgcataaagggtgggatttttccccctgcccctggccgtggatttactgatctgtatctccatattgttagtatctatcttcatgtatttggaaatgacttttgcaatatcctgcttgatcatctccagcatctcaggagaacagcctgccctgtctgatatcagcagtattttcagcctgtcctttgcaatttctctggaagttttctttttgaataaatttcttaatctcatgatatccgcccctcctgactcttatgaaagattccggtaaaccttgcccacaaggagaccggatgttccagatccaggaatggcacttcctttcccaggactctgaggcagatattctgataagcttgtcccgccagcgtgttattccctacaagaggctctccctggtttgtggcaatgaccacattctcatcatcaggtactataccgatcagtggtatggacagaatgtccaccacatcatccggagtcatcatatctccgcgttttaccatatcaaaacgcatgcggttgataacgaggtctatctggctgaattcatgagcttccagcagacccacaatacgatccgcatcacgtatggcggaaacctccggagtcgtgactaccagagcgcggtccgcaccggctatggcattcttaaacccttgctcgatgcccgcaggacagtccagtatgatataatcaaactgatccttaagatgctccactaattttatcatctggctttcatttacggctgttttgtctcttgtttgtgcagaagggagcagataaaggctgctgtaacgcttatcctttatcagggcctgtttcaccctgcagttcccttccaccacgtctaccagattatatacaatccggttttcaagtcccataaccacatccaggttccgaaggcctatatcagtatctatcaataccaccttctttcccatggcggcgaggcccgtgcccacgttagcagatgtggtggtttttcccacaccgcctttccctgatgtaacaacaattacttcactcatgcaaatacctccggttagaaatatttgtcccctgagcgttcctggagcttactgaacgttcagtaattcattcgtaattggtttcaggattatgcgttctttttccacataagccgtctgcggctgtattttaggtgcatggcctgcatttcggtcatttccatgaagaccataaagtccatgggttccgaaggtccatttgcttttttcattggcaatatatttgaaatccccgattttaattttttgcggggccatttcaagcgctgcaatataatgtccgggccgtccgtttccgcccgcgtaggcatttccgcgcaggcttcccagcacaacgatatctccggcggcaataacactggaaccgggatttacatcccccagcacaatgatgctggattctgtctccaggatctgtcccctgcgcagggtgccccggtagaattgtcccacagactcttcctcgcacccttttcgccggaattcttccagagccttgccgtaaatacggtttttctcttcatcctttccgacgatgcaggttatattcaaatgggaatttatccggatggtctctatcaggctgtcctcttcctcaaaggacagctccctgccctcaaaagaaaccgccacagaggcatcagagaaaaattcttttgattccttaaatttgccggccacctcttcaagcagctgtccaaaatccaaatcgctgtccagatacagggtaagcccattccggaagcttttaactattactgcatttttcatatccgctcctgtcccgatagtttttggcaatttcagaaaaaacattaatcttcggtattgacaacggcttccagctgactggccgtaccatttaatatatcttcctctttatcaggattaaaataatactgcagcactttacaggatatctgtgcggcatagtcggaagcatatccgttgccgatcctggttgcaatggctatttccgggttttcatatggtgcatatcccaggaaaagtgcatgagccggccgcagcttgttttcatcagccgtaccggttttaccggccgcggatatgcctgcatccacaaagtattttttcccttccaccacacccttcattccgctgtggatagcatcccagtatgcggtaggcatttctatggtattgcggacctcgggagtgaaatcctccagaaggtttccgcttcgatcggttactttatctaaaaggcttaagttatagcatgtcccgctgttcgccaccgtggccacatatcgggcaagtcctactgtggtatagttatgctcaccctgtccgattgcagacgcagaagggtttgccatggaaaactgaggcatggattcttctatttcaactccggacttatccgtaagcccgtaagcatccgcatattcccgcatacgggtattggcgagttcaaaattagttccgctttcaggatcgccggacaggccgaaacggtatcccatttcatagaagaaatagttgcaggaatgggttatcgcctgggaaacattcagattgccatgaccgtaggtattccagcagcgcatgacgatatctgagtatcgggtaaaactccccacacaatccacagtgcttctggtatcaatgattccatccatcagggccgctgaagcgactaccattttataggtggaaccgggagcgcttctcatctgtgtggcataatcccataaaggcagtgataaatcattctgcaggctggcataataatcggcatcaataccgtttgccagcttattgttgtcataactgggatagctgaccagagccagcacttctccggtattgggatccacaattacgcaggatgcggaaaaaggatccagagccagctgggccggagtaatctgaagatgttcaatcagtttcctcataaatgtatatgaggaagtacttccattctccaaagcagccttctcttcttcggaaacagaaacaagttcctgttccagcaataccatacatatctgttttccatttatggaattatcgcggatcatatatttatataacttcttatgaaacgctgttttatccagttccagactgatataatccacaagtctgtcaaaaacctccgaggaatccgcatactgggtatccatatccagcctgcttacatccacccaattccgggaaatagcatattccaggaaatcacttaaggatatagtctcttcctccgaccaggctttataggtttcgtctttgctgtccacagaaagcacttttgtatcgttaatcaatagattagtcactatatagctttcataactctgatactcttcagcgagctgattataaggagtccttctgttataaagttcctctctcagccagctccagacctgttccttcttttggaggaaagccgtccgtaccgcctgttcattgtctcccgcaccggcggaagccatatgctccagacttatcacattattattaaacaaggcaaaataaacatcatctatggggattttgattgtggaagccttttggtttgcccccagcttgaattccttaatgttttcaatcttatcaaggagcaggcctgcgatgctctgctccaggatattatacacagcttcctgcaaatccgcgtccaaagtgaggtagacatcatttccggcgaccggatccacccggccctccgaatcgatttccttccccaggttgtccacatatatggtttcgctgcctttttcgccctgaaggtatgtttccataaccttctctatcccggacttacccacggtatcattcatttcataacgatccggttcatcctctcccctgctggtttcttcattcaggctcttgagctcatccgaggagattttaccggtatagccgataatatgagaaaaataagtgccgttgatataacgtctgatagtatcctctgcaatatcaattcccagaagagcatcattgttttcctttacggcagctaccgttttttcacttacatccgtggcaatcgtcgtgggtatgtatttctggtagctgttagccttcatggcatagcggatagtaatcagcttaaggacttcggcttttgtatagccctgtccgggtacaaaggtgctcttgtcatccggatccgtcctttctccgataccataggtctctgccatataattgatcacatcctggggcgttgcgtttttttccttctctttcaggttgtcaatggaagcatgtccataaatatcagcaagaaaacgcagcagcttggtgtctgttacgttaaatgcgtattctccgtttttatccaggtagatattaaaatcactgataacactgtcgccattcttttcaatgatatgaatggtctccagaagcgtggcgttcagatttttgtttttattcttatctgactcgtatacatcttctatggttacggaataagccagatcattataagcgagaagcttcccgtttctgtcaaaaatctttcccctggaactggagatagaacgttcctttttgatcttcagggaaaattcattcagataattttctccctccacaatctgcaggacgaaaacccggtgtatcaggacgccgcccataagaatcacaacgagagtgagcactatcagcctggaatttattaagtttaaaaaattatctctgaatctctcaaacaattattcattactccttctttccgcagcttccagctttttatgtaataacagaagcagcggatataccgcaaaagcaatcacaatcgtatatacggcttccggaagaataacatggataaaataatacccgatatccagccggctccttaacaggaacaaaagcacatagcatacgaaattgtaaccgatgtcacttactaaaatcagaatcaacggcagtttaatatcctccggataaaacatcctctggaatgtgccgttgacataacctaccaccatataaagcagcgcataaaatccaatcacatcaccgccgaaaatatcagccagcaggccgcagaaaaatccgataagaaggccggttttttcaccgttcataaaaccgcaggatgctattaatatgataagcaggttcggcataatgctgctgaaggcaactgccggcaatacactggtctgcaggataaagcagaataataccagaaggaccgagattatattccttttcataaggccttctccttcctattccttatccatggaatgcttctcttgtgtaacctgctgttttaactccattataaccaggacctcctggatatgctggaaatccactgccggtgtgatatagccgtattttgtcatattgttataggatgtactgatggaactgataaaaccgatagggataccgggaagatatttattgcttatatttgaagtgaccaccttatccccttcggaaactttattttccttatcataaagctgttcaaaacggataacgccgtccgacataacagactgcaaatctccggaaaccatcagattttctgaggtggaaaggatcgtgccgtacacattggcattatctgcaataatggaaaccactctggcgtaattggggcctacactgaccacccttcctgccagcccgctgccggcaagaacattcatatctacctgtatgccgtcgtcggatcctttgtctatgacaaaggaataaaaccagttgctggaatcgcttgcgatcaccctcgcccctgtcttttcatattccgaagttgccttatcgatctcgtagagctccctgaggctggtaagctcatatttatcctgctggagctgcgcattttccatggtaagggcgtccacctgatccttcagcgcctggttctccgcaaggacctctttcagctgtcccatttcctccgcacggtcataaagataaccgcctacggaagcgattcccttctgaaagggaactacaacataccctgcagcagcccgcagcggaccttcaaacaaatctgttttaaaggtcacaagcatcagggcgacacagacacctgacaaaatcagcagcaggtatttacttggcagggtgaatttatttctttttttctttattacaggactcatttacccatcccttcaatcgcataggcaactgatttatagttttcatcgttgagaactttggaaaggccaataacaacgctttctaccggcttctccgctacatttacacgaaggcccgtattctttcccagcttctccgcaagatggctgatttgggatgcgccgcctgtaagataaattccatgacggtaaatatccgctcccaattccggaggcgtacgttccagaatgactttaacactgtcaatgatcgtatcaaaatgctcttccagacaggatactacaagttccgtagggatagtacgctcaacaggaaggccggtaacaatatcccttccgaacacttccgcaccgactccggcttcctccagctcggaaagggacttcttgatcccctccgctgttttgccgccgatgagcaggccgaattccttacggaccgtgctgcggatagcctcgtcaaatttaaggccgccggtcttgatcagacggctgagcacaatgcctcctagagacagaatagacacttctgtggtatcataaccaacattcactacaagaacaccctgggaattctttacgtcgatatccagccccagaccgtctgccacggctttttccaccaccatgatcttgcgggccttcacattggcgtcgcgtatcaaatcataaaatgcacgcttctccacctccgtgatatccgtgggtaccgcaatataaaaatctgccggcttaatatttccgccggacatatccgttacaaaaaaacggatcagtgtttccatattcttgatatccgcaatgactccgttgcacagcggataagaaatatgaatgtttccgggggctttttcatacatctcataagcggaatccccataagcgaaaacgttcttcttgttctgtacggctatcatgtttttttcaatcatgatcttatcatccgccgcactgtaaatcttgatattgctcgtacctaaatcgattccaaaagcattcgtagacaaaatgattttctccttccttatttcaacaggccggattccctgaagcttacatagcagttatctcccacgatgatatgatcaatcagcggaagctgcatcatgccgcaaagctcagccagatgttttgtaatttcaatatcctgcctgctgggcgatgcgtcgccgctgggatgattgtgtatcagcaggatatgtacggcatggtactcaagcgccacccggaaaacctcccggggtgagaccagagaacaatttacggtccctttggataatacccggtcacagatcatacggttcttattatcggtcataacaagaatcacttcttctgtctccaggtaccgcatcctcttcatgtaatagtctgccacagtttccggtttggtaaactgcaatctgtcacgggtatccgccatggacagcctgcgtgacagttctataatgcatttgatttttactgccttgacctggccaatgccatttaccctgcataaatccgcaacagataagtgctgcagcccgagaagtcccttatcccggcccttcggcagggacagtatctgccccgcaagctgcagagagcccatattcctggtgccggtcctgataataatggccagcagttctgcttcggaaagagactccggccctgttgcaagaaatttttcataaggcttcatctcttcatagcatggttctttttggttcttttgattcattttttaccccgtttcttcacgtattccgaacgctcctcacgggtaccgccgtctgtatgtatacttaaaagccggctttataccggcctcacagcttatagaatgcggtaaatcagcaaagcaatcactatccccagtatgcttgcgattgtaattttaattgtcagagcaaaggtgatactcaaaattccgaaatccagaatcagcgggtttgtcagcccgaaggtctgcccgaaattcataaaactagaaggaaacaggcttccgataaagccgcccagcacgattccggccaaaacgagcaacaaacaggtccatccgtttttacttttcattttcttcattcattcatcctttgtatttgttgacattacctatattagcatacttccagatctgtgtatagaatctaaaagtaaaaaatttcgccctatccgacagcgatcgacacctctttaccgtaatcggcaggagaagatctgtttaattacggcaattggacggctttcgcctccacgcaatgctgcagggatttcatgatgccgaattttacgtgcggccaggtaaggcctccctgaaaataagcggtgtagggaggttttaaaggtccgtccgcgctcagttcaatggaagaaccggatacaaaggctcccgcggccataattacctggctgtcataaccgggcatatcccagggctcaggccttacataactgtccaccggagctgccgcctgaatcccctcacagaatgcgatcagcccctccggagtgccgaaggttatcgcctggatgatatcatgccggctttccctgccgtcagggattacccggagtcccagacgctcataaacgttggcggcaaacacagctcccttcagtgcgctggccgtaacagtgggtgcaagaaaaagtccctggtagaactgaggcaggattccaagcgaagcacctacttcttttccgagtccgggggatgtgagcctgcatgcggcattttccacacattctttagtccctgcaatataaccgccgatgggggccaggcctcctcccggattcttgatcagagagcccacgcacatatcggcccccacatcagaaggctctgtacgttccacaaattctccgtaacagttatccaccatgcagataacatccggcttctgcttctttataaaggcgatcagctcccctatccgttccaccgataatgtgggccgcgtctgatagcctttggaacgctggatggtaaccacccgggtacgttcattcagggcgagagctatattttcataatcaaatccgccgtccggcagcaggtccacctgccgatagctgatcccatactccttcagggaccccctggatggacggataccgataacctcttccagcgtatcatagggcttgcccacgggagacagcagttcatccccgggacgaaggttgctcataagagccagcgcaagcgcatgggtgccgcaggttatctgcgggcgtacaagagcgtcctgcgtatgaaaaactgcggcataaaccgcctccagcgtttctcttcccaaatcattatagccatatccggtggttcccagcaggcaggcttcgctgaccttgttttcctgcagggccttgagcaccttcatttggttatattccgcggtttcatcgatttttttaaaccggccttccagttcttccagtatttgctgtccaaaatggtatacctgtccggatattcccatttcacggtaaaaatcagaaatattgctttcgttcatcttgtctccctttgtgctgtgtattccaatccttccacagacacttttatatttttaaaggcatttgtttttccctgcatttttccagcataaagagaaggatatcttcttcggaatcaaattccggtttttccacccatatcacatcccgctccctcctgaaccaggtaagctgccttttggcaaaatggcgggtatctctcttgatcaggtaaacagccctttccaaatcatattcgtcttccaggaagcctaaaatttccttatagcccagtccctgcatggaaaccatatcccggcggcatccgcgctccctgagccttttcacttcctccacaaggccttcctgaagcattttatccactcttttatcgatacggtcataaatggcctctctcttatcatccaggacaaaatagcaggcattatatgcggcctgccttttgcgttcctgttcgttatgctgggaaatttttttgcctgtctgcatatagaattccagagcgcggattacccgtttcacattgttggcatggatctgctctgccgattccttatccacggcagccagcattttatgaagatattccgggcctttttcatcggcagcctgttccagcttttccctgcaagtggtatcctccgggttttccgtaaaatcaatatcatacagcacagactggatataaaatccggttcctcctgtaatgatcgggattctccctctttcccggatatccgcaatggctttctttgccagctgctgaaaggtgaccacattaaattcttcttccggctccataatatcgatcaggtgatgggggattccctgcatatcccggcttttaatttttgcggatccgatatccatctgccggtatacctgcatggaatctgcagagataatttccccgtccacccttttcgccagcttcagagaaaggtctgtctttcctaccgcggtaggtccggtcagaatgatgagaggttctttctcttccatttgccttctccaatcgtacttttatataattcttttaaacttcttttccagctcatacttactcattgttatgatagtaggccttccatgagggcaatgatacggattttccagcttcagcagctgatccagcaaagcctccatttccctgaaggacatggtatgattcccctttaccgcggatttacaggccatggaagccagcttttccgcaataacggaaggggttccatgaggcggctcttcttccagttcatccaggatagcttcaatgaactccttttcgtaatgaccgtacaggtcacaggggaccgaacggaccgtataggcattgccgccgaactcatctatctcaaagcccatctgtgcaaaataggactcatagcgctccaacagatgggcttccctggctgagaggttcaggacaatcggcggagtgagcatctggctgtccactgtcccggttttcatcttgttgatcagggcttcatactttaccttttcgtgggctgcatgctgatcaataaaaagcagcttatcctcatactgagccagccagtaggtatcgaacacctgtccgagtatccggaagctttgcaccgcttcctttgtcagaagcttttcttcaaaaagctccatctgtttgacatcctgtacctggtacaggccttcctcttccctaagcatctggcttaaacgtcttgtttcaaatggctgcggtgcctccggcctgatgcggacggacggtgccggggagctttcgggagcttccgattgaacagaggcttcggcttctacctggttttccgaatggacagagacttcggctttttcctcgttttccggttggacagaggctggaaggctcgacggtgatggttcttccggctgctccggctgaaacgatgtctccggcacttccggcgcaggattttttatttctgcctgaatgacggcctcaggttgtttttctgccgcatgaagcgcaggagctgccgcaggcattgcagcggcttctgcttccgttggattttgggggctttccgaattcactgttgaaggctgttcagcaaccggcctcatgggcctgggaacattggccgaagcggcttctttattcggagtctcgttacttagagtttccttattcagaatttctttatccagaccgtctttattcgccgcccctttatccggaacttttttcgtttccttcctgtcttccagcgtcacatccggaatcatttccctgcgtctgagcgcttcccgcactttttcttccagaaaggcataaaggccgggctgatcatggaaccggatctccattttggaaggatgtacattcacatcaatccgatccggatcaatcgtaaaatgaagcagggcaaaaggaaatttatgctgcatcagatatgccttatatcctgcctccagccctttggagagcaaagggctcttaatataacgtccgtttacaaagaagaactcaaagttcctgttggaacgcacaacggacgggcttcccaggaagccttctatctgcaggccctctgcctgtgctgaaaacggaatcagctcctttatgatttcccggccatagatacggtacagaatctctctgatatccccgttcccggaggtatgaaaacgaacctgtccgttcatcataaactggaaggcaacttccggacgggaaagtgccatatgctccatcaggtctgaaatatagcttccttccgtggcataagatttcaggaattttttccttacgggcgtattgaaaaataattccctcacaatgatggtagtgccctccggcgctcccacctctgaaaattcccgttccttttcgccctcaagacggtaatggattccggtcagctcatccctggtcttggttatcagctccaccatggaaaccgccgctatgctggaaagagcctctcccctgaagccgaggctttttacctggtacagatcatctacggtacggattttactggtggcatgccggaaaaaggctttccgtacctgttctttttcgattccgccgccattatctgtcacacggatgaaggagcagcccccttcttttatttccacagtcaccgccctggcgcctgcgtccatggcgttctccaccagctcttttaccacgctggagggccgctccaccacttcgccggcggcaattttgtcaatggtactactgtcaagcagcatgatttccgccatattatgcttcctttcctttaaaaagccttgcctttttatcatttaccatctgttcttcagtttattctgcaggcggtacaatgtattgagggcatccagcggggtcatagtgcttacttccacattcttcagttcttccagcacatccgcatccgtaacggtatcaaacagggatatctgatccagatccagttcatcataatgctcctgctttttggaaggggcattgttttccgctatggatatactctgcaccttttcggttatatcgttgtcactcagctgttccacaatttccttggcccggtcaatgaccaaatccgggacgcctgccagtctggccacctgaattccgtaactcttatccgcgccgcctttgatgattttacggaggaaaacaatatcatcccccttttcctttacggcgatacaataattgtttacattgctcattttgccttccagttcagtcagttcgtgatagtgggttgcaaacagagtcttggcacccagcagcttcctgttgctgatatgctcaatcaccgcccacgcaatgctgagtccgtcaaaggtcgaggtacccctgccgatctcatcaagtatcaaaaggctgtttctggtggcattacgcagaatattagccacctcactcatttccaccataaaggtactctgaccgcttgccagatcatccgatgcccccacacgggtaaaaatacgatccacgattccgatatcggcctgccttgcgggaacaaagcttccgatctgcgccatgagcacgataagcgcagtctgccgcatgtatgtggattttcccgccatgttggggcctgtaataacagcaatctgacgggtgttgttgtccagatgagtgtcattggggataaacatgtcatgctcaatcattttttccaccaccggatggcggccgtcttttatgtgtatcagtcctttttcgttcagcttgggcctggtatactgattctgctccgccaccagggaaaaggaacagaaaacatccagtctggccacggcctttgccgttgtctggatcctttcgatttcaccagctatctgatccctgatttcacagaacaaatcgtattccagggtacaaagcttgtcctcagcatttaaaatcgtatcctcaagctctttaagacgcggtgtggtataacgttccgcattggtaagagtctgtttcctgacataatcctcaggaaccatattcagataggatttggtcacttccagataatagccgaataccttgttgtattttacccggaggttcttgatcccggttcgttctctttctgtattttccaaatccgcaagccagttctttccttccgtcttggccctgcgcaaggtatcaatgtcttcattatacccttcccggatcataccgccctcccggatggttatgggcggttcctcttctatggattcccctatcagcgcaaaaaggtcctcgagcccgtcaatttcttcttctattttctggttggcctcaccgggcagctcctttaatacggttttgatatggggcagcatttccatggaattgcggaaagcgatcaaatccctggggttagccgtcttatagctcacctttcccagcagtctttccaggtcatagatgggattcagatattccctcagttcatccctcgcaagaggattattacagaaggcctcaaccgcatccagccgttcttccatttccgttttatgtatcagcggctgctccaggaagctgcgcagcattcttgcccccatggctgttttggttttatccagtacccagagaagggagcctctcttctgcttctcccggagagtttcggttagctccagattccttctggtggaactgtccaaaagcatataacggtttgtaagataaggctcgatatgagtaaaatggcttaacggtattttctgagtatcatataaataggaaagaagtgctccggccgctatgaccccattagggaattcatccactccaagccccgacagggaattgaccccgaagtgcttcaggaggcacttcctgcacaaatcatcatcaaaataatgaggctccagagaatatatggcaatgcccagccgctccttcagatcctcaagctccacgccgctgaccagaaaagcatcattacatatgatttccgagggcatgtatttcataatttcatccagcagtttcctgttatcctcaacctctgtcaaaagataatcgcctgtggtgacatctgctacagagatgccggtttttcccgcaaaataagcgatgcacatgagaaaattatttttattctcttccagggactggatattcaggttggtgccgggagtgactatacgcaccacttcccgcttgacaagcccctttgccagcttcggatcctccacctgctcacagatggcaaccttataccccttgcttacaagacggctcaaatagccctccactgcatgataagggacgccgcacatgggggcgcgttcttccatgccgcagttctttccggtaagcgtaagctcaagctctttggataccgtaagcgcatcctcaaaaaacatttcgtagaagtctccgagacgatagaaaagaatacagtctgcatactgccttttcgtctccatatattgctgcatcatcggcgtcatttctgccatgtttttcgtttctcctttgcatttcccaataaaatccgcaaacgtacatcaataaaatatagcacaatttggctaaaatgtaaatcgtaagaaacgtcgtatacagcagttttccccgcccggcactaggtatccgcccgcccgctgcaatgccttcctgctgtgtgaatccctaaaaatgcataataaaaaacagttctgcacaacatcggcaaaactgctttcttactcattccctgaacccggaagctatgtgggtttgttgagaatatttgatgcaacagcttggaatagataatacattttgggggaatgatatcaaataaacaatttttatcaattgttactccaatgttctctgcactatattctcaacccacaatatgcagcatccctgtatccggaatgcaacaaatgcattataacacactttttgttaaaatggtgcacaaaaatgaattttatttcatttactactaaaaagtagtgttctcacgtaacggacatatgtttttctgttacacattgttttatttttcagaaaagtatgccgactcattatttttatacgccatactgttttttcggatatttatttccgagataacgggcgaaggctttatggaattcttctttgcgggaccgggagatcgtgagggctgtcccgtccatcagaacaagcaggtttccctccacctttgccacatatttcaggtttactatataactgttgtgggcataagcgaaattatgcatctccaggccggcataaatatcggcgagacgggaattgcagtttatgggagactcgtctttttcctgattcagccaaatctgacagcctctttttttcagggaaatataaaggattctgtcggaatcaagctgcatcatttttcccttataaaaagccgtgaggtacacatgcttcttccgttccgccgcttttttcaaaatagcggacatatcctcccgtcctttggaaagcagctcctgtttcaggagataacgatagggatagaccttaaacatttccggcgtggggacagccactccggtaacaaaaaccaatacggcattcctgttctggcttcggaaagcgaaggcagtctcctgtccgtccattccttccatctggatatccagaaagagaatatcatgttctgaaagaatatcctccatcaaattctcgccggaagcatactcctgaatatgtacaggtattcccatatcctcagcggtctttttcacaagctgggataaaatattcctgtcagcctgggaatcatcacaaaccgctaccttaagttccgtttccacatcattttccctttcctttcccttttcccgatacccatcttcagcccgcctgacggggcggaacggacagacagaccgttacacaaaaggtatttgtatgtacatcaaaatctatgaggccgtgattgctctctatcagctttttcacatgcttcaggcctatcccgtgacgcgcccgatccgcctttgccgtaaggaatattccctgaccgctgaccgctttgtttatacagctgttttccagccggataactgcatagctgcgatcggtatccatgaacattttgagttctatgcttcgttccccttccggacatcgttccgcagcctccagggaattatccagcagattgctcatgatactgataaaatcataatcctttatattccctgcatggaatcctggctcaacaaaaatatccatggatattccctttgaatcagcccttcgctttttttcattcagaataaaattcaatatgccgtttgcggaataatgggtctcctccgccctggagatatcagcatggatatccctgacaatttcctggattttatcgtcctgattttctcctgccagatagctgagagtattcagatatctgttaatatcgtgcagcacctgtcggtaattctgggtgacgcgttccagctgggcatagttttctgtctccatgcggttcttctgctgcagaagcttctgctccgttatctgagtctgcatctgcacattcctgttatagatttcaagaatcactatattaaagaccgcgagcaatgcgcagataaccgtcagcatcagcctttccaccgtcgtaacagccacatctgcataaagagtcacctgataaacaatccggatcagcagaagggataacgccggacacagcagaaacgggagggggaccgaagcctctttattctgccgccttccctgcatgagacggataactgcatataccagcagaatggcaaacagcttggcggcaagtatcacgacgaattttccggcattcatatccggtatgatatatcttcctccataaccggcacctattacaatgtcctcacagaaaataacaataaggatctcaataatattaaagtacagcagctgtctccggtttccttcgaacagataaagggctgatatcatgtatatgaaaacagtccctgtcagattgacaggaacattccccacgcaattgacaagtgacatgaaaataagaataacagttctcattccaatacgctgcgcagtactgttaaccctgtaattgaagaagcttctcataaacaggttccatatatagcattccagaacattggtcagtataataacggacatttcttccagacccatatctagtcctcatttccttcctgatgttaatatatgcaaatttttcccctaaggctgcatttttttccgatcgggttgcttatttccacgaattctttcataattctaatatcttatttatgaatgactgaggaggaattattaaaatgaaaaaacaatggacggtaaccgcagctgatggaatgaatcatgttattgaatacaagggacgcagccttcttgttgacggccagaagtacccgctgaaatcatctaactggtttattcagctgatcgattatgccatcaatttcggagaaacccagtgccgtcttgtggttatgggaaataaagtggacctggctgttaacggccggtacctgggaagcggcgaaccttatcagcctattgccagcctgcctgtatacgtatccgttctcgcaggtatcagctgtgtgctcggctttctgatgaacagctggctggggctctgccttggcgtacttatcggagttatgtattttaacctggctcttaagaagaaaaatggtatcatcgtagtcgctttcatcatcgcttccattcttcaggttgctttgggaatcggcgttgctttccttctttcctgatcgaacataggagtatgacttaaatggataattataattatcagcctgataataaccaaagctttcaaaacggatatccccagggggctccggttcccggacagccgcagccgggccagatgcctggcgggcagaatccttattacaacaatccccagggcggcgtttatcccggccagggaaataatcagccttatcagggctatcaggggccggtggttattaaccagctggaacataaaaaagataacctggccgtatgttcgctcgtattcggtatcatgggcggaatattctgctggatactcgttatccctctcgtatgcagtatagcaggccttataatggggattataagcctgataaaaacaggccagcatacgggactggcgctgggaggcgtaattgtttcggcaatcagcctcgtcatcagcgttgtttttactctgctttacatcgttctgatataagaaattcattattcaaagcaatatggccgggagcaaaagctcccggctgtctttctttaccgccatgtgttccagaagggtttcataaaggcgtaaaccgccagcggaactactgcggaatttatgagagacatgatgatatcgctgccgaacaacgtaacattcaccgcaaagataaccacttccgacaaacagataatataaaagcctgtcttacgccggttaaacaacaggatgctgacacctgcaatctgaatcagttcaaggatcataccggccgctgctgcagaagcatctgccagcaggaaggtccttccataaaacagaaaggtcaagatatccataaccaggacaatccagagacagattttcaggcctttggacatcagccctcacctcccgccatttcaccaaggaaataaaaccctttatattccttcagatataccggcacaattctgccgattaaagaagcatctccggggaaatgaaccaatgtattgttagaaagtctgcctgtgaccaaagtggaatcctgttcgttctgttcttccacaagagcctccatagtcaggccggaaagcagcctcacacgctctcttgccgtttcctgaaccgtccttaataccctgtcaaagccttcctttaccacttcctccgacacctgattctccatggccgcggccggagtccctgtccgtttggaataaataaaagtaaaagcattgtcaaactgaacctttttgataacatctatcgtttcatccacatcctcaggtgtttcaccgggaaagcctacaatgatatccgtggtcagagcgatatcaggcatggcggtgcggattttatcaacaagctccagatactgctccttggtataccggcggttcatggcctgcaggatcctggtggagcctgactgcagaggaaggtggaggtgccggcatatcttggaggaggcggccattacctcaatcagctcatctgatagatccttgggatgggatgtcataaaacgaatcctctgaagtccgtctattttctccacctcccggagcagcccggcaaagctcatgggctcctcaagatttttgccgaaggaattcacattctggccgagcagcatgatttccaccacgccgtctgccaccaggttttcgatttccttaatgatatccttcgggctgcggcttctctcccgccctcttacatagggtacaatacaatagctgcagaaattgttgcagccaaacatgatattgattcccgacttaaaagaatattttctttctaccggcagatcttctacaatcttatccgtattctgccagatatcgacgatcattccctgctgttcccaggcagaagccagcagctcggcaaatttatatatgttatgggtaccaaaaatcaaatccacaaagcgatagcttttccggattttttcaatggttcccggttcctgcatcatacagccgcataaggcgattttcatatgcggattttttttcttaaggccgttcaaatgtccaagacgtccataaaccctctggtccgcgttgtcacgaaccgtacaggtattatagatatcaaaatccgcctcttcactgtccgtcagctgatagcccgcctgctccagaatgccggaaagcttttcggaatctctcgcgttcatctgacagccaaaggtggtcacacaggccgtcagcttcctgccaagcctcttttcctcctccgacacaaaaacgcggcattttttcaggaagtaatattgtctggccggctcctcaagaggcggctgtgaagaaaggtcaatgctttccagtattttatctaaattttcgttattcatcctttgttccttactttattttcttttcgatgccatgctccgcgtacagcgaaataatattgagaattatttccacgcacttttccatggattctatacatacatattcatatcttccatggtaattcattccgccggtacacagattagggcagggaagacccatgaaggagagcctggagccgtccgtacctccccggatgggggcgatgagcggcgtaacaccggcttcttccatcgctttcacagcggtatcaatcaaatgggcgttttccggataaatcttttctttcatattgtagtagctgtcctgcatttccacagtgaaaatttcttttccatatttcttattgaggaaatcggcggcctccctgaaataggcttttttcttctcaaacaattctctggaatgatcacggataatataatctacctgcgcactttctaccgttcctgtcattctgtccgcatgataaaaaccttcatagccttctgtagccgccggggtttcaaataccggcagaagagactggaactcctgggctagcaggatggcattcagcattttatttttagcgctgcccggatgtacgctgtatccattgacatgcagccttgcaccggctgcgttaaagctttcgtattccagttctcccagcgcgccgccgtcaacagtataggcataatccgcctgaaatccttccacgtcaaaatgatccacccctcttcccacttcttcatcaggggtaaaggctatccggatggtgccgtgttccttttccggatgggcgagcagcgtttgggccattgtcatgatttccgcaactcctgctttatcgtctgcgcctaaaagggtggttccatccgtaacaatcaactttttcccttcatattccagaagctccggattttcctcaacgggaagaataatattcagctcctgattcaggacaatgtccttcccatcataattttccacaatgcggggcctgacatccttaccgcttacagccggggaagtatccatatgggcgatgaatccgataaccggaacctcttttccttcctccttcagagtggaaggaatggtggcatatacatagccgtactcttcatccatcctcacatcagaggcgcccatttccttaagttctcccaccagcagacgggccaggtctttttgcttttccgtactgggagaggtggtgctgtcctcgtccgactgggtatcgattgttacatattttaaaaatttatcaactactgtgctcatatttaaacctcctgctgctttccttcccgcgtgcggcggggtatttgactgttaaggccggatttggccgtttcctcgtattgcatatttataggtagtcagctccttcagccccataggccctcttgcatggagcttctgggtgctgatgccgatctcagccccgaagccgaattcaaaaccatcggtaaaacgggtggaggcgttcacataaacgcaggcagaatcaacctcatttaaaaaccgctctgcattttccgcattttccgtgagaatggaatcggaatgcccggtattataacggttaatatgggcaattgcctcatccaggctgtccacggtctttacggaaaggatataatccagatattcttttccgaaatcctccggtgcggcaggaaccgctcccggcacacaaagcaatgtccgttcgtctcctttgatttccacgttcgcctgctgaagcgcttcggcaagcgcaggcatgattttttccctgattttttcatgtatcacaagggattcacaggcattgcataccccgatacgctgggttttggcattcagtataatggggatcaccttttccatatccgcgaattcatccacgtaaatatggcagttccccgtaccggtttcaatcaccggcaccgtactgttttccactacggcgcggataaggccggcaccgcctctgggaatcagcacatccacatattcatttaatttcatgaaacgggaagtggtttcccggtctgtgtctgtaatcaattggatggcatcttcacaggagccgctttctgtaagggatctccggatgctttccgtgatggctgtattcgagtcaatggcatcgcttccgcccttcagtatacaggcgtttcccgctttaaaacaaagcccgaaggcatctgccgtaacattgggacgggattcgtaaataatgccgatcactcccagggggacacggcgtttttcgatttccagcccattgggacgggtaaaatgttcaagcacctctcccagcggatccggaagaccgcaaatctgaagcaggccttccgccatagcttccattctggcatccgtcagcctcagcctgtccaccattcccggatgcatgccgccccgctccgctcgttccacatcccgtgcattggcggcaagaacagcggccttatcacggagcagcccttcggcaacagccttcagggaggcattcttatcctcagcagtcattttctgtacttcatattttgcagcgacggccgctcttcccatttcagtcagatccatacatttccctcaccttccgccttaccggctgatctaaatccatccctcttccgtcagaatacggtccgggcgtacatcggtttcttcctcaggcagttccggaagcacctggcagttaaaacagacagctatttttaccgcagaacaggcattttggagaaattgatcataaaagcctcctccgtaacccagcctgcgccgctccctgtcaaaagcggttccgggcatgagtatcaaatccttcccggagcttccaacccagattcttccttccgttattcccggttccagaatcccctggtatcctttcaccagttcatccctgcagaatacccggtaaaaggccatcgttttctttttcccgcccgctgtggtttccggctccgggctatcttctattttaggacagaaaacctgttttccgtccctccaggcctgttccatgatttcataggtcggcacctcatcccggtaagaagcatatatcagtatccgctccgcattccggtaggcgctgtcggcaaaaagcagcccggcgatccgccggcccgcgtcggtccgttcctccatggtcattccggatcgtctgcgcaatgcttctttacggcattcttttttattcagcattctttttccccaggttggtgacggagccgtcttcattctggatattaatgttattcagctgagagcgcagattaacctttacactgttgatatattccttgcgcagccgggcctgctcatccttttcttccgcgctcaggccttccgcctgggatttatggtacagttcattgattctctttattttttcatccattgtcatcggttctgccatggcaatccactcccgtcggtttattcccgcgagcaacgagccaaagccaagctcgcttggccttggcgactgccgcgagggtccaattccccgcagcttgctgcgttacaagtttgataccccatcagctcactgcgggggattggacttattcagtttgcttacaaagccgggaagatcaaaattttcatcccttttggcaacaaacagggttccataattcctgccgtccatcagcctatgtataatacggatatcccggctgttggcaatcagcatgtccgctcccgcctttgtggctattttggcggcggtaagcttggtattcatgcctccggtgcccacattgctgcctgtgctgcccttacccatatccatataggtatcattcagttcttccacgatttccacaaatttggcctcggggttcttccggggatcgtcggtataaaggccgtcgatatcggaaagcaggatcagcagatccgcccctatcagcgccgcaacgatggcggacagtgtatcattgtccatttccagctcataggtcgctaccgtatcattttcattgactaccggtatcacccccatctgcagaagctgggagaaggtattgtgggcgttataacggttaaggttatccacgattgtatttttggtcatgaggatctgggccgtcacctgattatactcggaaaaaatacgctggtaggtcatcatgagccgggactgtcctatggcggcacaggcctgcttcatagctatgcggttatgctccgtgatgtcctcttccttcagattcatcgcctttttcccttgggcgatggctcctgatgtgacaagcaccacttccttaccctggtttttcagattgcacagttctctgaccaggacctccagtttgatataatccagctctcctgtctcaggatgctggagggatgaagaacctatttttacgacaattctctttttatcctttagtttttcgcgatactgctccacttaaccgtcctccgttgcgtttatctcaagtcttcccattattttatataattttataacgtttcgcaatagcttcagcgattttcatgccgtctatggcggcggatgtgatgccgcccgcgtagccggcgccttccccgcagggatacagcccctttatcgttgactgaaaatcatcctgccgtgtaatacgaacaggcgatgatgtcctgctttccacaccggcaagacataccgcatcatccgcaaaaccgggaatcattctgtcaaaggcttccattccttccataaaagcctttctcagcggcgcgggaaataacggccgcagatcggcaaaggtatattcccctttcatacagggaagaaaatccgcgggaaccctctgctttttttgtcccttcggtttttcggcaaactctccatatctttgtaccggaatccgccctccgccaatattccaggctttttcctcgagcatgcgctgaaaagcgatgcctgccagcggtcccccggaagaaccggcatataattggaaatcctccggtgtgacagtcactatgatggcgctgttggcatttttcccgtcccgccggctatagctcatgccgttaaccgcaagccttccttcttcgctgctggcattgactacataacctcccggacacatacagaaggaatatacgcccctgccctcttctgtctttgctgtcagtttataggcggcaggaggaagctgctccggccactcgaccgcatactgcgacagattaatcagcgcctgtggatgctccacacgcaggcctacggcaaaagactttgcctccatgggaatttgcttttgttccagcatttcaaaggtatctctggcactatggccaatggcaagaatcactgcttccgaaaggaattcccgtccgtcagcgcatgttaccccgattatttcatctttttccagaaggagctgatccacacgtgcattaaaatggacttctccgccccaggacaggatttgctcacgcatgttcttcactacttcagaaaggatatccgttccgatatgaggcttgttttcatacaggatccgggacggagccccatgctctaccaggatgcggagcacttcgccgcttctaccttctttatctttaatcagcgtattcagtttcccatcggaaaaggttcccgctccgccttccccgaactgtacgttggaatcaggcatataggggcctcctccccagaaattctccacatccctggttctggactgcacatcctttccccgttccagcaggatggggcggtatccggcccttgccagcagatatccgcagaaaagccccgcgggtcccatcccgataatgaccgggcggtgccttgcgctttgcgttccgggatccgggaagcggtaaacgacaggcttcacaagggaaacactattattgcggcaccttcgaatcacattttcctcactgccgtttttcagtgttacgtccaccacataggaaaaccatatctccggcttctttctggcatctatggactgcttcaccacattgcaggaagctatctgttccggggcaagacgcagtgtcttggcggctttttcttccaccgcctccggcgtatggcccggtttcagtttcatctgctgtattctaatcatattttttcctctcagtcctgattgaaagcgctgccgcctgtcccgcaagatacccgcttgtccatgcccactggagattataaccgccgcatctgccgtccacatccagcagctctcctgcaagatataagcccggacagcagcgggattccatctgagaatccacttccgtaagaggcacgcctccggcacacacctgggcattggcaaagggattggaagcggtcaccgtcacctcaaaattccgcagcatgagaaaaactttttccacagcaggaaatgtctcggacgagacagtatcttcaccatgcagcccgttcagcttccacattgtctggattatttttttatttaccagaccgttaaacagcacttccatgcttctttggcggcagtccctgcattttttctttatgagggcctgccagtcatcgtctttgccccggaaggcaggcagaaaatcaatggtggctttcaccttacgcccctgggaaagcgccgctgatgcgaatctgctcagctggaataccggaattcctgaaatcccgtaatccgtcagctgaagctctccctgttcttcatattcttctttctttccttttccttctatggtaagaaggataccggcctctgtccgcacaccggcaagtcccttccagaagtttccggcacagcgcagctgtaccagagccgggagcggagttatcagagtatgtccgaagcctttggcaagctcgtagcctcccaaatcggcatttttttcgcctgccgcacttccgcaggaaagaataagccgcctgcaaaaataactctcatcgggagtctgcacataaaaaccggcattacgtccttcccttcggtacgctgccctctccaccctgcattccgtaactgtatgtactttcctttcctccagtgcaaaacgcagggtgtccagcactgttgccgcctggcctgaaagaggatatacatagccgtttctgtccgttaccagcattcccagccgttcgaattgcttaagagtatcctccgcgccgaaccgggcaaaaaaagaagccagcagctccgggttccggcttctgtaaaaaagtccgggtttttccacggaaaaagacaggttggttaaattacatttcccgttccctgtcgccagcagtttttttcccactctatcctttttttcaaaaattatgatttcacagggccgccccttcatactgtcagccgccgcgacagccgccatcaggccggacgcgccgccgcctataataccaatatctattctctgcatggataccgattcctgtcctcaaattattcccattataatactaactggaataagactcaaggaaattatacagttcggcctcacttcccacatatttaaactgaagtatttccttcgccaattcagcggaaagactctgcagcgggattcctgtagacatatattttgtctttttatccgcttcataaaccactacatagttattttccacggccaggtagaactcggtacatttctttttgctttcataatttttctggataaccacttcctgtgcggaaaacttctgaacatccagcgaaaggaagcccttattcaggtcattcaaagatggcgattccgaataactgttcatcgccgaaaggaattcgtctctgtccattccgatatactgctccggtatcggactttcctcctcttccctgctggaatcagccagatccaggctttttacgacaaaacgggtatcgcaggtaatcaccgccccgccggtacccagagcctccatactttcctggttttccgccgtatccccgtttccgccatcctgcacatactgctgttcctgtttggcattctggcttggataaaagaaatcatgaagctttacagaggccagaaagcctacagcaagcatcagtatgggataaataatatatatgctgatttttttccacaaacgcataagaacctcctgctcttactgtcccttttgtatcaagtatcagcattttttcaattatttatacaaaagacagccgcaaacagcggctgtccctcaaatttcccgtccattccggctacatcagccggaaagcttttccaaaaaagataataatttcgcctccgggaatttcctttaattccctctcagatatcccatggagcgctaaaatcaaagcaatataaataagtgttcccacaagaaagcaaatccatgacataacgccgctggatattttttccgtaagcagtctgttaatcaggaaaataaccactccggacactccggcggaaatgacagggattccgatcatacgcccccagtcaatgcgcagagccagccttctctgtatcgaaacgagattgaggataaacagcagtgcaaaaagtactatcacagccaccaccacacccgttatatccatttttaccttgccaataagcacataaagggtaattacatggacgcagaaagaaataaaagaatttatcagcacattccgttccctttccagtccctgaagcacaccggaaagagccatggaaagcgcctggaagactatggcaatgcttccgatccgaagaagctttgccgccagctccatttcccctaccttaaacagggcgggaattaacgtatccgccattacggcaaaaaacacggcggcaggaagcgcgagcagaaccgacaaacgaatcagcatctgcgccttgtccttcagcctgccgatgttcatacttgcattggaaacagaaatagccggtacaagggacgcgcatacggcggtaatcaaaacccccggcatatttgccaggatcctgtatttgccggaaaacacaccccattgtgttatgctatcccggcttgtcgggctcagcttgaggaacataatctgatccacaattacgcttccctgtgtaaccagtgctatcaatacaaccggcagcgtggaaagaaccaggattcgtacaatcctgcggtaactttctgtgccctttcccatgtccttacgttccttcttccggaaactgctctggaacatggcgaagaccaccagtaaaaacagaagcggcactgcgcttcctatcgtaaggccaagaactcctccggccgcgccgaaagcctgttcataattcctgttctgaagcagggcgcctaccttggccccatattttcccatattgccggcagcaatgagcatcactgcaagacagagcacctcctccaggaaccgggatacggatgtaggtaccattgtacccattccctggaaaaatcccctgtacaggcccagtacggaagccaatacaatatttatggaaagaatcttcatggcaacagcgctcaggggttctccgtaaatgcttcctgcgaggaaatcagaaagaaacagcattaaaagggtacataacaggccgcctcccagggtaagggccattgatacattccatacccggcgggtattccggaactgtccttttgagcatctggccgaagtcatttttgctactactgcaggtgcggcatagccgcagaataaaaagaaaaatgtataggtatcgaaagccatgctgaaataagcatttccattatctccgatgatattggtaagaggaatcctctttatcatggagagcaggcctgccagggctccgcagcacgcaaaaaaagcgccgtttcccccgataccttcctgttttctcctttttctttttttcttatggttatccatagccactctcattcgtattgtaatccattctttaagtcattatgtcaatcactgatatctctggtaattcccagcctgtccagaacatggttctgtttttcttccataacagatgcctcatcgggttccatatggtcatagccgcacagatgaagcatgctgtgggctattaaaaaagcatattctctgcggatactgtggccaaagctttccgcctgttccagaatcctgtcacaggaaagaataatatccccaagaatcagttccccgctgtccggctggaagcagtcagcctccatttcctccgccaccgaaaaatcggagggaagctcaaacgggacattgggaaaagacaagacatccgtctccctgtcgatattccggtattcccggttatacatccggattccttcattgtccgtaataaggatatttatttctgtctcataggggcagttttcctcttcaagaacctctcccgccactagggaagcggtttccataggatcaaagggaaagatatagtctgtttcattttcaacaaaaatggtcatctgttaaatcgtccttttccttttctggcataggaattatcttttgtgtcccgctgctggggccttgtccgttctctggacagttctttattttcgtaggcctcataagccttgacaattttctgtaccagcggatgtctgacaacatccctgcttgtcagggtacagaaggctatgtcatcgatcttgtgcagcaccttagcggccacatccagcccagaattcacgccgggcatcagatccttctgggatgcatcccctgttacaatcaccttggagccaaagccgatccttgtcaggaacatcttcatctgcgccggtgtggtgttctgcgcttcatcaagaataatatatgcgttatccagggtacgtccgcgcatataagcaagaggggcgacctcaatcagccccttttccatattttttacaaaactctccgctcccataatctggtagagcgcatcatacagaggcctcagataaggatctaccttgctctgtaagtcaccgggcaggaatcccagcttctctcccgcttcaatagccggccgggtaaggatgatcctctccacctcattatttttaaacgcggtaatggccattgccattgccagatatgtttttccggttcccgcaggccccatgccgaatacaatcatattgttccggatggcgtccacatattgtttctgcccaagtgtcttcggcttaattggcttgccgctcaccgtatggcagatcagatccccgtctatttccaaaagtgcatcattattgctttccatgctcatctcgattgcataatccacattctgttcctgaatctggtttccccttttcgataattccagaagctgccttaagatagcctccgtctgctccacatgctttcgtgaaccgcttatccgcacgccgccgtccctgtcaacgatggtaacatccagatatttttccagcttcttcacgtatttatcatactcgccgaacacattcaggatatgcgcggcatccatttccacgatcgtttcaaattgctccataaaatttactgactgctcccggattctgtctcattctcagcaacaggctgttcggcttcaatacgctgtgcttttccgtcatttccctgcaccgtcatatatccatccataaccagcgtattgcctgctgtttctattttaacatctttttctattatttgtacccctttttcttctaaacttactatattttttgaaagcttctcattcaggagcgcttctgccttattttcctggtatacggcctctacaggaagatattccctgtgtacctcaaagccgtaatagaacggcagataaatctggttcaaaatgcagagctgccgggtgtccagaacagtgtcatattttaaaaatccgcagtctcccagctttaaaacatatcttttatggccaagggaaaagaaaacatcctttttttcccggttggtgtaattcttgtattcgtacatgagcggctgttcctcatgtacgggaatctcatataccagggatacatccgcgtccgcatggcagaactgatactctctgactgttccgtcgtccgccatgacaggcactgccccggatacgagaacatcccctttctgaaccggggtaccctccgtaacaaggggaactccctgccgcgtcaatatggaaactacaataccatcctgcgtggcgataaggttgcttcccggccagttctctttctcatccggagcttcatccggtgccaaatcattttcttttatttttacaataaaccgggtgccttctattctggcggaggtccaggtgacaatatcgaaattttctcgcaggctggcctccaaggcttcaatatcgattttattttttgccaccccataatcaattcccttttccgccaggaaatccatgagtacatcatctgtaatggaaacattcccttcgaaatctatggcccatacaaactgggacatggctatgagaaaagccaggcagcagggaagtccaagcgcaaagatcttcctttttctcattttccgtataaaaaaaggcagtccgtatcgttccagaacggctgcccttgttccggtctttctcactatcggccgcagcttgtagaaaccggacaggctgatatacatggtatagcaatcctcctgccttgcaatatcccacaacaggatatggtgattgctgcacaggttcataaaccgttcaggagaatatccccatacttttatcttcagatatccctgcagataccggaaaaattctctcatgattatttcctcctcaatttaaagataccggatacactggatcgttccgattatcttcatatcctcgttggtataataatcaatgacaagcccgcatccgcagatggagatctgtccggtcttggcctgcagggttatagattctctggtatattcaataatccccttgtaattttccacccatagctcatgattcccggtcatggtcaggatggaagcgcccaaaagcatatccttcggaagtttgagggtatcgacaagctgctccttcgggctcttttccattatttttttctttttggaagcactgatttttctactcatactgcattatatgagcgtttttacctcttcataaccggattctttccagatccatcggtacataaaccgtgccatggaatgaaagggcggcttcccggctgtaggcttcctttcttttttccagacaggtatcctccgtatggtacagcacaagattggatacatgcagttcctccgccagccttccggcatccagagccgtactgtgatgcttttcataaggatggaatatctctttatccctgtccagacagaaggcctcgctcaaaagccagtcacagccttccacataaggtctggttacctctttgtagggttcatcccccagacaggaaagcaccataccgtcttcgaagcgggcctgaaaaccaaactgctttgtttttgtggaatggatatcaaaaaaagtgagcttcattcccgccgctttcttttctcctccgtcctttacctttttaatcagtatcctgtctcccagaaagacagtgaatttttttaccagcgtaagcgtacacagctgcataatggtatcagccaggtcttcatggcagtatattttaaaattgccttcgtaagcgccgctgcgcatcatagtggctaccttccgtatcacccacacaactcccagcacatgatcggtatgggcatgggtaacaaacatgtaatggattttatccacagggatctctgcttcttccagacggcccagaatcccatttccgcctccggcatccacaagaagatattcctctccgttctgaatggcaaagcaggtattatagcattttgttaccatagcatttcctgtaccaagcattatcaaattccgttccatcttttgtgctccttttatttgctttaatcatttttaccaataacaattacattttagtaatccattccccgccagactgaatttccacttgccatttcaattaatcccataccatctctcccgttctgctgttaatcgcccgctatttattatagttaatttatgtttaataatcaaagtattttttaataatatatgatcctgaaataagttattatattttcatcactatagtggtattgatccacttcttgacttacatctcctttgtgctataatctattgagtaagtcataactaatcataattcagaaacggttggctacataaaatgattatacctattctgcagatgtattttcataatgtaatgcaggcatttatcacgatgaaataacagatatctccttttttcatggcatcccaaatatagcaaaaggagatataaaaaaatgaataagcataaaaacaaactgctgatagccggaatcatattggtggcctgtgttctgcgcactccgctgacgggtgtcggctctcttatttcgcagatcaggccagaactggatctttctcatttcctgtccggcatgattaccaccattccgttaatcgcttttgccgcagtctccccctttgtcgggaagctgtcaggtgcatttggagccggcaaaacactcactctcagcctttttgttctcactgccggcattgttctgcgttccatgggcgggtctgccggattttttccgggtaccgctgtcatcggtatcggcatcgccgtcggaaacgttttgctgccgagtatcattaaatcggcattccctgataaggtcggactcctgaccggaatctacaccacctgtattgccatatctgccggcgtttcttccggcatcagtattcccctttcccacagtaataatttcggatggcggggttctctgtccatctgggttttgctcacacttcctgccatcataatatggctcccgttatggaactaccgtacaaatgagccgtcagcaggcggacaggtcagcctgaaggtattgttaaggtctccggctgcctggagtgttaccgtttatatgggtgtccagtcactgctcttttacagctttgtggcctggctgcccgccattcttcagtctaaaggaatatctccggattcgtcaggatattatgcttccctataccagtgggccggtattcctgcttcctttgcggtgccgttattggctgccggatataaagatcagaagctgctttcagccattatctccatcatttatgccgcaggacttattttggtgctggtgtccggcggtcataccggacttttaggcggagtgcttctctgtgggttttgtacaggcgcttgcctgagtctggctatgtgcctgatcgggctgcggacgaaaaatgcatctcaggccgcctcgctttcagggatttcccaatccttcggctatgccctggcagccgtaagccccacactgttgggtggcatttatgactctatggagtcatggacagtccccctgctcgtacttattgccatgacggtcatattgctgatttccggcgtccaggccgggcgtaaccgtacagtctgctgatataatgaaatcccacagaaactgcggaaggtatctctccatggcagtttctgtgggatattttttctgctattttctgacatattctcactcgacttctatatcttttcaaatggcaattatatgtattttcaattcgcttttaacgttaaatattgcaaaacaatatgcactttatccgtattattcaaaacttttgtagccaaaatgtagccagagattttcattcacctcaacacctataagccaccggatacgatttaaagtagatgaaacttttgtaacacgaactcgccttcacaggtgagttcgtgttacaaaaagctaaatataaatctcctaatttaccaacaaaaacaaacgttctgaaaacatttgcaaaatgacaattaatttttcaaagcaactgacaaactaccaccaaaattattcatggtaaaacgttcgtcttgcagcagcatttcctttgatacagtgcactcaaatgggaataagtacgaagatgcattaacctcttggaataaataataaccgctaccatcaacatttattatagtataaaccataaaactgttgatttcatcttttgcaaccttgtgcctgttgatgtggtattttcccggtttatcgcaggcaagtacaccaaactcttttagagtagaaatcagcttgtcgatagagtggtatagcgtcgtgcgctcaccccattcatcaaatagcttctgcttcagctgggccagcgtgatttcgtcttgaaactccgacattttaccgataagtttgcacatatccataaaaacaggatatgccgccagcatcatgcaccagtggatttcaagtgcataatccggatacttcttaatcagctcaagtgctgtgggccgtaatttttctgtgtattcattttcataatgccagatgtacatcaagatttctctggtcttacgaatatttgtagggcttcctatttcgaagctcaaatattcattcaatttttcttttatttcgttctctaccaaattgctcgaaacaagctcaacggtttgattcaaccatgacagcttcaaatttcttgacagacctaccatttttgccattaatttaccgcctttatcttaataaaaggtactatgacctcatcaattgttatgccgccatgcgtcattacttcttcaccctttgcatcgaaggagtctcccacatcgcaaataaggtaatcaaaagccttattcatataatactttggatactctatcaagccatacttttgcataagcccgtctttgtcagcaaagttctgtagaacaatcatccttcggctctttgtttcggtttctacacctgttcccattaactttccaagccctgtgcaaggcgtattcccgtggtctgcggtgatataaacatcaaagccctctgaaagaaaacgcttcgtcatgtcagccagcttatgttggtctgaaagaacaccgatgtcattcagcattcccagacggccttggtgttgggcgtgcaccatatcatccacatcgttaatgataaccgcaccgcacttcacaaaggagccaaactgtgcatcataccctcgctcatatcctatctggttatctgtgtatcccattgaccttgcgcaggccacaaactcctgcttttccttgctctgcttccaaggttccattagctggcccggtgtcttatttgacagaagacactgtcgggagatggaggtggtacttggaatcatcgcaaaagcggctgattgttcatattgaaggtcatgaaacgactttgcaataatgctccagtcaaatttagacataccatccataacgataatcacaaatttgttgctatggtcgttcatatactccattgcacggctaaccagcaccggagtttctttattcatttcagtggagagcttaccgaattccttcaatacataatcccggaaagcccgattgacttccgaagtatcaaaattcaaacgatactccgttgacagcgtgtcaatctttgcttttgtttctgcaagggcaaaccaatctcgatagctcttggcggtagtaagactttgcaacagctcagaataacgctgttttagatacgcagcgacattctctgagcaatctaccttctgatggagaaattcctccgtctgcttacgctgtcgcaggtcatcaaaattcttcttatacgccaaacagagaagctctaaatccaaattacgtcgagccttaagggcctccatattcagtttcggaaacagcctgtccattgaaagaaggtaaactctaagtcttcgttggaggtcatagggaatatagctacccgaatgtgcaagcaccaacagcttgttcgctgtatttttcagcttatcctcgtactcaattcggaaggtcaaatcatccgtataatgcaccacttcgaagccatgtgcctgaaagtccgcactgtaatgagttaattcttccaatccctcgtcgtctataaggagtattcgattgttgtattctgcggctgcttgttttaacacatagtctccaaacatgcgttatgcctccaatctgactgccagcatcaagcggaaattgggatacacttgtgcacctttcttgtgttcagcttcaatgatggccttctctttttctaacttcgccaagcgacctcggcggatattgtcaattccaatgtgctcggcagcttccatacgaagctgtaaagcatacatatatttgttgtaactttcctgattgagctgcagctgcttttccttcaattccataaaggtatcataagcaaattccatactgagcttttcgaggccagcatattgctctgcactcatattcggagctgtcccaattgtcaaacgactggttccatcaaggaatacctccatcaaacgctttccagccatcgggcgtaaaatcatagcatcattcacgaagattggaataatcctctttccgctttcgtcatcagatatggagagctcccacagcataaagcaacctgcttcattcgggaaatttgcaatgctcactgagagcaagggactcattctgtcttggaggatttcagtctttagatgtttggttatttcctcatcgccaatactgatacggtcaatcagacgagggtcattgcctttccagcactcataataggtcatcatggtgcgtagggccacatccacatcgaaatcaggttctgttccgaccagacgtgtcaggtctttttcttcacgaatgacatctttatatttcttcgcattggcaagctgttgcttcatctctgcttcgattggataggtattcttttcaacctgtcctggatgaccaaccgagcgcatatagacctctgtaaaatcgcactcagctacttcgctatccagaacatcggaatacttatctacgcccatctccttcaaaataacagagagtttttcttccagcacttcacgcacacgattttccacagtatccgaaacaataaaattgtagatatgtacatctcgctgctggccaatacggtctgcacgaccacaacgctgctcaattttcataggattccaaggcaggtcgtagttaatgatgatattggcaaactgaaggttgagaccttcgccaccggcatctgtcgaaataaagatactggtgttgtttttgaactccagcatagcctcattacgctcttcaatattcatgctgccgtttaagaccgtaacggaaaagccacgatttaccaacagtgtctgcaggtacttctgtgtagcgacaaactctgtgaaaatgattatcttctgagtattatcatcgctcataatagaatcgatagcttccagcaaaggctccaccttagcatcctgattctggaactgcgcctgctttgcaacagaaataatcatctgaagctcttcagtttccagttccatatccagcgagatggcctccagtgcttcttcgacaccgtcctcgatatccagttcctccagatcttcctcggtcaaatttccaaggtgagtccgctgactacgcagaacattcaggcggcgctccaaactctgacggattgctgctgtactactggttaccatgcgctgcatgataataagtaaaaatattaggcacatgtttttctttttattacgtagtgccttgttgtaggtttttgaaacgtaagagcttaccaactcataaagttccctttgtagattgttacgctcgtcccaagtcaaggaaacaaggtgtgttactctgtttttgaagagcaaattaccgttgttatcaattgcttctctcttttctgtgcgaattaagaaaggcgacacctgttctttaacaattgattttgcattcgggaaagcctcctcatccagcagccttactaagcgtaggaacggctcagtctttccgttatgcggagtagctgaaagcagtagcaaatatggactggcctgcgctaacaggctgcccaatttatatcgtgccacttctccggaggagcctgcaacacggtgggcctcatcaatgataatcaagtcccagccactgttgatgatggaataaatacgctcctcgttgtactgttctatacgttcctctgtccaacctgcatgcttttccagcggcttgatggaatccatcggagagataacctggtcgaactgtccatacacgtcgttgctatctgtaagcctgcgaatcgtgtcataatcagagggaagtatgacatgaaatttctcatggaacttctcctgcatttcactgccccattgggttactaagccagtcgggcagactacaagcactctgctgacaagtcctcgactcttcagctctttgataatcatacctgcctcgatggttttaccgagacccacttcatccgccagaatatagcgaatattgttagtctccattgctcgattgagcacatggagctgatgaggcaacggaatgatactgcttgccagtgacgaaaggaagcctccggcggtctcgtttttgatttttgaaagctgcatcacatatcgcaaataattttcatcatagcgaatggtattaccttcaggatttaattgttcttcagtcgctttatagaccttcccggttgctggattgaaaaccttgtaggagacgtatccccatacttcaattctctccagcatctgcacattcgcttgcgaaagcgtgtcaaaagcgaaatcgccgatttccagcattcctcttcacctcgtattcttagatgcggcccaagctaatatcgtagtacataagcaagtttgcatcctcttgaattgtctgctcaggcagacgattgccaatatcaacaatggccttataattcttttccttccataggcgtgagaaacctacacgaacagcctcggaacggaacaatttaagtttgcctttgctgcttaaataaccttcgaattctttccaaagattcttctcgcgaagtttgacaacgtcgccttccttagttacatcagggatataccattgccccttctcatcctgaaggaagttttcttcaagaagaacagacagttccggcatagactcgtatttgtcgacagactttacttcctgcatgaatttcggctgaagttgggcatatgtttgtctttcacctgaattatcatctagctgctgatataaccaagcaatggcgctcttttcgtttgtcacaaacagcccaaattgaatcggctccacatcggtttttatgcgtgcagtatcatattcattcacttggtctgcaaggaagtacataccatctcgttttagaaatttatcatcaagtcctcggtaaaaatcgcttgcatcaataggaaccggaagcccctgcataatgtggtatgctaccatacggtcaaataaaagatacgcctgacgttcagcaagaatatcaatttttccatcattattggcgtccacaacaataggaatgtttgaaagatgttgacgcacaaatgcccaagcggtttcttcagtgcctgtatttgcaacgaattcccttataaaaccagtctgcggtttataagcagaaataattaggtcttgtttgactgctgaattattcaaaatttgcttaaaagttccttgctgtttatccaatgttctcacatcagcaataataaaacctgcacattgtagcgcctcttgaatcgcattccaaacagaatttttcgaattatgaaattccacagtcatccaacgattaggttttagcaccctgtagtattccttaaaacacaattccatcaaacgttggtaatcaagaagattttttccggcaacttgattaactatagcctccattgtgttatttgtaacacatcccatccatgcttcccagaagaaattcaattcagagtagtttaaattactgccgaatggtgggtctgtaaaaatataatctatagaatcattcggtacgggtgtattagtggtagaccctgtaaaaacgcatgccgactctccatcaaatggaacctgactatacatttttgaaagcttttcaatttttccactgaggatgtattctggactgacctcgaccacttgtgaaccaatgtacaatgttccactcaaatattgattaacctgtgaaaaatggcttggaacataccttgatattttagccatccctagaattatctgttcaaagacaaaccgcattttttggctgttgtgtgatttttttacctgttccatgaagaacgcaatcgaaagcaaacttcttctggtataaaaatggtgcacatgtgtaattccgtatttgtcatttctccttgtttctcctccttctggcatacgatctattgggtaccaaaaagggattggagttttctgtattttctcaattagcgccaaatcctctacatctggttttttttcaaatttttttccttgataggtatagttaatcaataccggcttttgctttgacatttgaattgtgctattcaaatcctcgtcgaacatggtgaccatagcgttagagcaatctttttttgcaagagtgctcttgcaatgtggacatacaaatttgtcaattaccttttttgtctcgtaatcaaatgccacttccgaaaacacaaactctgatgaacaatgtggacatacaaaaacatctgaccatactgtatagttaatataaccttgaggctgagcttctaagcttatctgtccttcattagagatatgatttgtcttatacatccatccgtagttttcttcaaacagcttcagtatttgggaggtttcactttcaaacactaatgcatttataccagtattttggttataggcgataaatgctgctacaggagaaaggtcgtttaacacaactttccttttcccccatattgcctttttatcctgtgaaatcatttgaaattccaattgcttgtcatcggctccacacatttgcgccgcaacaccagtcatacccgttcccgaaaacccatcatatacaacgtcgccaggattagtataatgcaagatatagtgcattatcgctttatagggaacttttgtgtgataattatgggcgccatatacaatatcccctttcccttcacttacatccgccgcatatggctccctatgataatcatccgtggcttcatcatatagagttccattttccttgataaaatcctcaataaacggatttgggcatgccgtataatatggcgcatccgaaagagcaatgatatcttcatccttggcaatcggaaaaccttcaataccacgtaccttgtcgatatctgccttcgttaagtttcttggctccatgtgttacacctcgctatctttccgcttcactacaatacgcagtttagccgcatcttttccttgaatgtaagactccacgatgctgctcaatttattcttaaaggtagttacatcgcaaggcccaagctcatccagttttgcaataatgtcctcagtatcaatcaccaccggctcaaagcccagaagcagagctttaatgctgtttacaaagtggtcatccacacgctttggcaaggccttaaaggaaataaactcatcaatggccttctgctgctctgcactcaggtactccttctggctaaccacaatcgggtcagagattgtattgagtagcgtgtttgtccattcagccaccaaatcgtcaatacgaatatcgatgttatccagctggccagctacattctttgctttgtctccataggtataatggcaatgagggcagatatggctggttttcaactcaaccggaatcagctcataacaaaccttcagttctgccatatcctgctcgatggcagtcagctttgcaccagagagtatttctatgctacgcagtttacgcagatttgccagctcgatgctttcctgcagcttaccacgacgctttgcatcctcaatgtcaaggtgctttttcttatgctcctcaaagtacatcgtgatgtatttttctttcagtttgtccagctcagtcgtaaccttttgtgctgcagtttcaccggaagttccatcagcaatgctatctcggatttcacggaaggcggtctttccggcctccaactcctgctttaatactgccccaaggtcaaggaattcaatatttgcaatatagctaacgactgcggagcaatctgtcttgaaggttacatattcagcaatagtcttgatgagagcaatctgctctgccaaaacatcaacctgttctcccgaaaggctgaaattattcagcttcgcaggtgtgttgtacttcgcagcataattgctaaactcatcacgaacagcagtgcaagccttctgcattctatctacctgctgtgcatttgccagaggctcgccccaaagttcaaagccttcctgcaacttacgtactgccagaacagaagaattgctgatttcctgcgcctttgctaataactgctttataccttcttcacggtcatttggattatccagaagcgcaccattgatatccagaacttcgaacagcttcttcagctccaccatagaaatctgcgccggtctggacagatacttgaattcatacaaatccataactcccagccttggcacctcgtcaagattggaggcagtgataaccgtaccgtttttcaaggtcatcgtcgcataacctgcatataccatagacaggaatacaatcggtgtgaataggaagctaatcttgaatttcttatcttcaaacacatctccgaacttaagctcgaacaaatcggagtagttgataacaccctgtggcggtaatttcttcagctggtcaatataataagcagcatacttagagccttccggacggattttctcaccatccagaatgccaaagctctgaagcatcagtgctgcaggctgcgttttacgtcctgcaaaatagtcgaaagcctgacgggcattctctgccatgttctttctggttatcttggttttcatagcagggaactccggataaatgctatcaaagtattcatcaaggcaaacagaggcagcaaggtcaacagtatccttaaagtccatatctctgttgtaacggtccttcagaacttcaatcatctgtcgcttctggcccttgtactgcacttcaaagcaagtgttcttgttctcgctaaggtatttgatgagtctcttgcgcaccataccggccttgttcaggtaggcatccttatccttgccttcactgatttgtgccagggaattggctgcggcaaataaaccaagcagctccttgaattcatcggaagacttgaagaagaaatacacttcatcttccagattctttacagcgattgctgttgcactgtacggaggcatgatgtggatatagaagtctcgctccggctgagcagtgctacgttctcccggtaatccgaggaacaggtagccctcacggaagatattatgagaatcccaattcaagtctctctggtagatttcaaaaccaggaacgtactgctttgcatcccaatccaaacagccataaacaagctgatagaagaaacgattcagttcgccttctgccataacggaagccttctgcttgattttctcatcgtagtctacgaccttgtccacgtcgatataatactgattgttgccatcgttgaagataatgaactggccagaaacggtggtcatgatatccttcagtgtggtcttaatcaaagaaagcaggaagtctgcatcctgctccggcatcgtcaggaagaggcacaagtcatccttcatattttcagcagtcaagccgaactgcacatccagaccattggtggtcaagcggtgtacactcagcgcataaataatcttaattgccagcggcttgtaggcaggcttagggaaggcacggttgataatatcctccagctgaccacttgcggtaacaacacggttgatggttacgtcgctcttaagcagaccattggatttgattgcaggccaataatcatcgaaagaaataatgcccggtgcattttccggcacctctgtattgaaaatatcccgaatggtcgtagagatgttcttcagaatatgtctattctcaattaagtaaattttattaaacacgtcaatgtaagacggatgaatcggatacaggtctacgaactcctccaaacgggaggacatgcctgtataaaggttggagaacttctccagatgcttacgaatcaaagccttctgttccggtgactttttcaaaatacgctcggaaacaacataagatgtagcttccttcgtgatgatgagctgcgtaaaacggtcagatacatgtttcagcgtatcagatacaaagctgaagcgtgggttatcgaaaatcttctcctgaacaccaaaaatgacacggagcttgcttttagagcacatttcacccagcgcacggaagaactccaggtcgagaacaatctggcgttcgtcacgagaggtcaagtaggacagaaactcatcgactacaatcaggtaacccttgtctggatacttttcagcaaaggccatcatcatgtcctggatcacttttttaggattgtgtacagtggattgctcagggaattcaaaatcgacgtttctcttatcaaaatcgtcctgaatatagcctgataaaatgtcgtacagtgacatggtaacgccaccgatttctatacgcaatacttcaaatttacctgcgatgcattccatatcctttgcaaaggccttattctgcaggtactgtaaattgtcagcatcttttgcaattgaagaaatcacactcatcaagtgagatttaccagtaccatagttaccaacgacaagtgcgcccttgttatcaactacctcatccatctgcagctggtcaatgaccggtgccttcaaactctgtgccatgccctcagacatcacgtaagttttaatattattgatttcctctgccttattgctgttggactgaaccagctgcaaggtagattcaattggactaaagctaattagctctgaatatttcatcttgtatttcctccttatacgatgcacgtgatgtcataagcatccacgtcataagtcttgtaatcttgaaatccttcttctgcgtaaatcagtcttctaccatcaagtatacctggccaaataatactaaacggctttaccttgcatgtgtttatcataatttttagcacatctattttataatccggattaaatagcacatcaaaatccttcagcactacattatccgggaactttgcgagtattttcgcaaagcacttctctatttgcattgttcgttgcttatgtccaaataaagccaacccttgtgcgagctctttatttaatgacagtgctaaacatgtaatatcttcataattagagcagtagataattggctttaacaaaccttcgcaattcatcgaagaaaatttttttctactaataattatacccattgaattctactcccttcattttttgtctattctcaaaatgatggctatacacatttatgtagctaattaagtttataaattacatgaatggtcagttttattcttagtttttttagcaccactcgtgcgcccgtccgcaggtttttttgcatctatcggcaccaaccagaggttgccttttttaatagccccctctatccggccgtccttgcaatatatcgtaaccatacgccccgacacattccacttttcaccgacttcttttacagttaaaaagtcaatcaaatcagacacctcctagctataattactctagcatattatatttcaaaatgtcgaaaaaagcaatagaacgctggaatgacaaccggcctatttaggtgttgttcagtaatggcaagcaatgcacaggtatatacaccccgtgcttttgcttgttggtgccttgcccaaacccccaaagggacagagcgttttatgctgtcccttttaagccgctatgcgtctgctgcgccaccttacggtgtgctattttcttagaaatcatcgctcgtcatgtgctatggattttgttgtttccgctggctgttgcacattcaaaatcctatcaatattatactttgccatctgtaaatcccccatcttctgccgagcctgtttgtactcgccatagagtttgtttttctgtgaaagcagcgtggcatattccgtttttactgcatccatagaaggcagtttttcaagctccagcttattaaatgcctgcttcaccgccttgtgtaatgcgatgtcagattcatgcgccgccagaaactttttgctatatcctaactgccgatattgcacataaatatcacgggttttgcgataaataccgatgtatttttgcaggctggtgattacagaaagtcgcttttcacttgccttgattttagcggaaagcgtatcaaaccgctgtcctacctcctctgcctttgcagataaaactttgtaatcatccagcccgttttcctacaaataaatcaaggtcttagccgcctcttttaggttaaaagtttttgcccatttctcatatcccacacccttgccctgctgcaactttccctcaatatcaataagtagactgggctttttgccggcagggagagaaggcttttccttcaccgttggctttgcaatctgcttgcatccaagtcgctttaaaagttcgtgttctgtgtaattctcccccaaggaatcgcagcggataaaccgcttgccctgcggcaacttcaccgccaagtgtgctttatgcttcacttcgcaaccggctttacgcagagcatcttttagctcatccaaggtcaagctttgttccagatttgcattaatcagctctgccaaactctcccgcagcgtgggctgtttttcatccccaatccatgtaccataactgccacggctcagcttcggcttttcaataatggacagttcattttctacacatagcctgtcagaaattttgcgaatggcaaagcttgagccccagaaattccgaaactttttgctgtagtctagtgctgtggaattaaagataatgtgggagtggacatgagatttatccacatgggtgcacaccagaaaagcgtgcttttccttggtcagcgacatagcaaggtcatagccaatcatgttggcggtggctgggtcaatttcgccgggcttaaagctctggcgcaggtgataggcaataataacatcacgctccccgtggcttcggcctgtaagcgtcgcatactgccgcttggaaagcaaaaattcctcatccgctatcatagtgtcacattcaaaaaaagaaatccactcgccgccatcggttttatcgggattttccacgtagttggttgttttgcccagtgcagttgccacgctgcgtcctttgcctgcatgtaaaggcatcaatcttgtggtagccataaacacctccataaaaatcgtggggcggagcattgccatattgcagtgcccgccccttgatctgtcaaagcttggataaggatttgagcacctcaccaaaatcgctcatagtcgaattcagctgatttttcacatcggcaacatctgtttcgtagatgctgcccgtctcgttggctcgcttcgccatctgattaacattgttggaagtgatacgcagcagtcgtgaaatctcgtttaactgcttgagatctaaattgataatataaccgtcaatcgccatcttgcgaagataggcgctggtgttgcgaatccttgccagtgcctttttctgctgtatcaaatcaagttctgtggctgatagcttaaaatatagtactgtatcacgtttatcttccacgtaaaggcctccttccattcctcttgttggcaggcacaggaacgtgtcacgctcctgtcattggctgataaggaaggctcaccaccggaagtccgggaggtatcccttcctgtccaaatattcctgccgtgcctgttcctgctccgctgccgtaggtgcggttttgtacttagtataaagattgcgattcaccatggcatccagtttcttctgaagctcagacacaatttcttcctgccataaatcatcctctaatagatgaaaccgtagtagcatataaaacaattcctcgctgatttgcaaattcttcatgttctgaactccttttgattctgctttcacttgtatcactcaattcactaaaaatgatagaagtgataccggtgatagggaaactgtgtctactatccatctcgccaaggggcatcccttgggatatagtccacatccaccacctcattgccacgaacgccatcccggcgaatatcatagcgactgcgtagctcgcccacaaaattcttgctgttcagtggacggtagccgttgtccttaatccactctacaaatctgcgatagagggcgccggtgggcacacgattgccctcggattccatcaaggtatcgtttaagaatgtgccaacgatgtccgtctcctgccggtattcctttgtggcttgcagcacccgttctggaacggtcaacccctcaaccttcagcagtcgatacccttctatcagccagttaaatatgccgcttaaattgctctgctgctgaaaaagcgccttgagccccgtgtcctgctcctgtggggaaaagtgccgttcaaaggggatcagcttcacacggtcactggaaaatacagtatcatcccctgtgcagggcaggtggttggtattgataaagattttaaactctggggtgaactctaccggattttcgtgaagaaatcgcccggtataggtgtcgccgcctgtcagctgtttgatgagggcggcgtttagctctagccctcgctccggctccggcatattgagaaatcgtacgcccttgagccttgcaatatccggggatggagaggaaccgtcacaggagcgccgtgccagtgtctccggctgtgccgttcttgcgtactcacccataatggtggagacggtctcacaggcggtggtcttgccgtttctggtggtgctgccatacaggatgaaaaaacattccagtgagatttcgccactcaagcagtagccaaaggatttttgtaaaaatcgggcggtgtcttcatcgccctgcatcacctctactataaactgctcccagcagctgcactgggcatctttatcataaaatgcccccgacagcttggtgaggtaatccgtagggctgtgaggctgcatggtcatggtagatagattcagcgttccattttggcagttaaacagaagtttgtcgctgtcaaagtcggacaagctgcgaggtgtaatggagcaggcatcccgcaggatagattctctgcgctttcacctagatgtgaaacgcccaccccgtgatgaaaactggcaatgctcgattgtttttgacggaaaggataaatcggcagactttaacgccggcttctgcctgttcttggaggaatggcgagactaccgtgatgaacggcaagagggtacgctgtccaaggacaagtaccaagactggcaggagaaaacactggcttactactcatcaacggctgtcaacagcgacacggataaaagcgaatagatatagaaaagtcgagtcggaatttaatgaaaggagaatttcatgtccgtacaaaaagattcaactaccggaaaatggattgtacaatgccgtgttaccgactggtaaagcaatgtaacccataagaaaaaacgaggttttccgaccaaaaaagaggcgcaggagtgggaactcaatctgctctccaaggcgaaagccaatgtgaatatgctatttggcgatttcattgaactatacttcgaggatttgagccaccgcttaaaggcatccacgctggcaaacaagcactggattgtagaccaaaaaataacgcctgtgttcagtaaaatcccattaaatgagatttcacccacagacgttagaaagtggcagaacaagctgacctcttatcgggatgagaagggcgagggcttctcccaaacctacttcaagaccattaacaatcagctgactgctatattcaattatgcggtaaagtattataacttacccgaaaatccctgccataaagccggaagcataggcaagaaggatgccgacaagatgctgttctggacaaaagatgaatttgaacagtttattgaggcaattaaggacaagcccacatcttacaccgcctatagacactgtattacaccggtatgagaatcggtgagctaaccgcactgacaccggctgacattgatttagaaaaagccaccatcagcatcaacaagtcctatcagcgactggatggcaaggatttgattaccacgcccaagacgcctaagagcaaccgtatcatcaccataccacagggcttgtgcgactcctgcgggagtgtatgtaccagtgctatgggctgacaaagaccggctgttcgccttcaccaagcactttatgcggcacgagatgctaagagggtgcaaggtatcgggagtgaaggtcataagggtgcatgacacgaggcattcacacgcctcacttctcatcgagatgggcctctcaccgctactcatcgccgaccggctgggacacgaaaaggtgcagaccaccatggacacctacagtcacctttacccaagcaagcaggcggaggttgccaccaagctggacatactcatgggaacggtagccgattcgcagaatgtagccaatttgtagccaacaaaaagaaaagtccttgcaaacccgcatgaatgcagggtttgcaaggatagtagacctattctcactctataaagccgctctgcccttttacattccttatcagaaatcagaacgttgaaaaacacgcttatatttgcaataattccgtgacagtaccgcagtacgtcaaactcaatttatgcatggctctggtacaggcaatatacagcagatttctgtcaaattcggtttcataagagcccgcattcacaaaaggaatgagcacttcatcaaattccagccccttagaaagagggatcgaagtgatgtgaatcccattttcaaaatgagtactctcataattcaaaagatgaaccggatactgttttgacaggtattcataaaggagatttgcctgccggaaatctttacaaagtattcccatcgtcgcataggagctttttaaaaacacttcagcctttcggcggatgattgttaattcctgttcaggatccgcacagcagactgcttccggtgtctctccgtggcgttcaaccggctgaattcgctgatcacgcttgatacgtcttgcaaattcaatgatttcacaggtagagcgatagcttttagtaagactgacaaacgttgcttttccgaatatctgccggaaaatttcgggagaacagctgttatagggggtaatggactgtccgacatctccgagaatggttttcctgcagcggaacagtttgtttatgacggcgtactgaatcggtgtatagtcctgcatttcatcaataacaagatgctgaatggcactttcttcaccattcccctccacagccaggtacatataaagatatgggtagacatccggccattccagcgtattcccggcggcaagtccaaacagctccgttgttccttgacgggagtaaaaatcacggtaaagctccagcgttccgtccattttaaacatagaacgcagtttcctgacaatctctcctttgggaggcatttttgtttccgaaaaggtatccctccttttcagcatttccagaatatcatctgccattttaggaaaccgccgcatgattggataactgcgataagagttatagagtttttgtataaaatcagcgggaacagccatgcatccgattgtacagtcacaggggataaaatatcgcttttccgcatccataagatattcatctgtctgccgtacaaaatctgcagatgatttgtattccagcttcttcagccattccggggagcgatcctccgcgtgaacagcatatttttcaaagaatatcttatttccaagaatcatttttgcaatctcttcgaaactgagctctgaaatcggctcttctcccagttccggaagaacgtttgaaatgtagtctgcaaaaaccttgttcggagtaataatcgcgacattctgagctctaagacgctccttttgacgatagagcagaaaagctatccggtgcagcgctatagaagtttttcctgatccggccacgccttgtataattaagatttcgtcattcacattacgtataatccggttttgttccttctgaatagtggcgataatattcttcatcttttcatctgaggtggagcttaattccttacaaagaatatcatcatcaatattcatggtgttttccaggacataaaccagattacctttttctatcttaagctgccgcttacgtacgatttcaccctgaattctgcctgccggagcttcataagccgcaggccctgtctgatattcataatatatgccggaaataggggctctccagtcataaataagcgtccgtccacggtcgtctgtaaatccaaagaggccaatgtagatctcttcggcgtttgtatcgccgtcaaattgaaaatctatgtgtgcaaagtacggagactctttgagtttttttaccctgttatacgaggcaagcgtatgattgccggtagcttctatacagcttatggatctctcattggaaaagcgttccatgggatccatctcattccagcagcctgtcagatatcgcctcgctttgttataatcgtcttcatacccggctgccgatttgtcgtatttatccagagcagcctccagctgctcttttaccatatccagatattcagcttcctcaggaaacatattttccatgaaattacctcctctttaccacacttgaatggaataccgacatagtatataccatccgaaaaggctggtggtaaagtggaggctttgtttcccggagtcttttataaaacggacatgctcaaggctttatttatgatacggttccccggcattaatccgaaaacctctgtaaacctgttccagcaggatcacccgcatcagctgatgaggaaaggtcatatcggaaaaactcagcttttcatccgatttctgcaggacagacggatgaagtcccagagaaccgccgatcagaaactgtatatggctgacgccttttactcccaatcctccgatttttgatgcgaacctttcagaatccatctttttcccttcaatcgccagagcaatcttgtacgcatcatccctgatatagcggttcatgcgctctccctctttcttcaggatctgatccttcataacatcactcggccggtcgggcgtcttttcatcttccacttccaatatttccagtttacagtatctggaaagcctttttgcatactctgcaatcgcttccctgtaaaagttttctttgacctttcccacacatattactgatattttcatatatttatccctgatacgcttcaacagcccctgaatagtattcagaggctgctgtccgctccttttattccgcgcatcgcctgactcctgacgactcaaacgaaaggttattcccgcgttttttattcatcttctttgtcatcaccgaaaatatccgggtaaatttcatccacaaaattttcaagataaccggactccaaattcagaaaatttttggaaatcatactgcggatttgctccgtacgcttaaaatatcgtaattcttcctcttccggaagatccggtatcgaagaatccacctttgatgaggtaagattttcgtcacaccatctgcggagttcttccttcaatgcagattcttcctttgcctttccttcaaattttcttgaagatttcagggaaaggatacccataacaataaataacagaaaaagagctcccattacaccgccggtaagatatcgcgcactgccgtagaatcggatgggcaaaacttctgcataaacacatacaagaagtatcattccggcaattcccgccacaagaagggtatacgctccggaacggaaattttccgccttctgggaagccgcttcgtaaagcggttccgatacaacggcttccgcttctttttcttcttccacatccaaaagagctttcgtttccgccgccgtctcttcttcagaaagttgaacgctttcttcaccggccttttccttccgctccttcagatttttttccttctggaaaacctgaaggtaacgggaagccctgaccttctcttccgaggctatgaacaattcatacaaatcctctgtctcatcgaaacggatttctccgcttttcagtccgttgcaggagaagaaggcgagcaattcctccatctcctcctcactcccgaaaatgagtccctctttctcaagttcatccaaagaatctattaattcacagccacagtccgtacaggttttcacgccttccacatattcgttcttacattttgggcaccagggcatagcgttacctccttgttttttcctttttacaggctttcgtagtcaaaacaagccctgttacaggtcacttctttaatataggcacccgccttcacatgatccggatggatctgataggcattcagagcctcaactgactcaaaagaggaaagcagggcaatatccttattactggatgccagttcattgacacgaacctccaggctgataacgccctgtgccttttctttaatggcctccaggctttccttgattctcctgccagcttccgctttctgttcttcggtcagcgtttcattaaaattccataatacaatatggtttaccatagtaaactcccttattcggataaatattcgtcgattcctttagctccagccttgccagcccccattgccaggattactgtggcggctccggttacggcatcaccgccggcgtaaacaccttccttggaggtcttgccgaactcttcatctgcaacgatacatttccacttgttggtttccagccctttggtagtggcggaaataagcgggttcggagaagttcccagggacatgatgaccgtatcacagtcaattacatattcggaatccggaatctccacaggacgtcttctgccggaagcatcaggctcgcccaactccatcttcacgcatttcatgccgcatacccagttgttttcatcctcaaggatttccacaggattcgtgaggagatcaaagataattccttcctgcttcgcatgatggacttcttccacacgggcaggaagctcttcttcacttcttctgtatacgatatgtacctcagcgccaaggcggagcgctgttctggcagcatccatagccacgtttccgccgcctacgacagcaacctttttcccgcgcatgataggcgtttcggaatcttcgcggaaagccttcatcaggttgcttcttgtcagatattcattggcggaaaatacaccgttggcattttctccgggaattcccatgaatttgggaagtcctgctccggaaccgataaatactgcggaaaatccttcttccgtaagaagttcgtcaatagttaccgattttccaacaataacgtttgtctcaatagtaactcccagagattttacgttctcgatttccttctgaaccacattctccttgggaagacggaactcgggaataccataaaccaaaacaccgccgggctcatgaagagcttcaaaaatagtaacctcataacccatttttgcaagatcacccgcacaggtaagacctgcagggccggatcctataacggcaacttttttcccttttttctcttttgcgccttcaggcttaatgttattttctgttgcccagtcggctacaaaacgttccagcttaccgatggagataggctctcccttaattcccctgatacattttccctcacactggctttcctgagggcatacacggccgcacaccgcgggaagggctgaggattcgctgatcacctgataagcagcctcgatatccccttcctttaccttttcgataaaaccgggaatattgatggatacggggcagcccttaatacactgcgcattcttgcagttaatacatctgacagcctcctccatcgcctcttctttattgtaacccaggcacacctcttcaaagttggcagccctcacctttgcatcctgttcccttacaggtactttatttaaaacgtccataatcatcctccattttgtcaatcaactcgtaattgcatttcattcccttcagcctgcacaatttccgcatccgccgtgatgggttgctccttctttggctttcaggaaagccctgccttcttctgtcttataaatctgctggcgtttcatggcttcatcaaaattgactttatgtccgtcaaattcagggccgtccacacaggcaaacttcacttcgccgcctactgttacacgacaggcgccgcacatacccgtaccgtccaccataatggggttcagactgacaactgtggggatattcagtgtttcagtcattttacaggtaaatttcatcatgatcatgggaccgatggcaatacatacatcataggttttgccttccttttccacgagatcctggattgtctgggtaaccataccgcttcttccataggatccgtcgtccgtggtcacataaagattaccagctacggccttcatttcctcttccagtataagaagatcctttgttttggcgcctacgataacatccgctgcgattccgtgctcatgcagccattttacctggggatatacgggagccgttcccacaccgcctgctacaaagaggatctttttacgggacagtgtttccaaatcctcttccacaagttcagaaggacgtcccaaaggacctaccacatcatggaaagcatccccagccttcagggaggacatttcaagggttcctgctccaacaatctggaaaacgatagtaatcgttcccgcttctctgtcataatcgcagattgtaagcggaattctttccgcatccgcatcctttcttacgattacaaactgtcctggttcacaggattttgcaacccttttcgcttccactaccatcagaaaaatgttcgtggtcagttctcttgcctgtaaaatctgatacattttttccctccatctgcatttgtttatttatgccttataatagttactcctccggaaggtttgttccggaatttatatcttgcagcgtcaatgtgggccagggttccttgcgcgtttcctgtccctcatcacctccggaatcaggcagagtctgtgaatcgtctgccttaacacctgacgccgaagcttctttaacagcctgtacagctttataacacaatccatccatgatgctcaccacataatctgtgccggtaccggcacggtttcccgcatcatcttcgtaatattcccggtaaagataataatccgttccgtctatggtcacagcgtatttataaccgtaaacattgtgaccggttcccgtctttacgcttccgcccatattctggataattccagcatttactaattcaaaaagaagcttgttccttgcagcttctatgctcagagacgcatgcaggttcagcgaatatttcacctgtgtttcttctcccgccacccctgaagcactgtagcagacaaaacggaaggtgtttacacccacgggcatgggaaacggcccggtatactgcgtgctgtccgccgtaggaagcgttccgtctgtagtatagtaaaccgtataatcctcctgggcttccaccgttattaaggcaggacgggtatattccccttcctccggggcaacaagaggagcctccggtacggtcacatccacataataatattcactggcttcctcgctctttacatcataagcgttgatgaacaccgcccggatatcatactgcccggattccaggaaaataggggaggaatataccaggctgttttcatccggcacactcccatccgttgtataataaatggttcccttcgtattggcaataattttcacggacagcgtttcattatataccccgcctttataggaaaactcagggggcttggctatataagccgggtactgatttacaatctgttcatttccgcaggaaagaagcagttcattaattatatcatattcttttctgctctcatatatggatatcagccgtttataggccgcctcgttactgttatccatctcaattatcgtatagcagagagatatggtatcctcttcatttccggccgcataagtacagccggccagacgaagcagataatccacattgtccggttccagttccaccgctctttgcgcataggcacaggccttcacgtaatcttttttatctatgtattccatcgccttattatactgataatctgcgctgaaatgcctgacccccgccaccgcagagcctccggccccaaagaccagcagcagaaggatgattaccgtaacaattctccgctgtatagacaaagacagaaaacgcttttttatacgccggatttttcctttcaggaaaggttctgtcccgggagccttcatggaacctccggcatccttgggccgcgcggattccatcctgtcggacagaatttcatccatgggaaaatcctcttccacggagaaggtttccgtggaaaaggtttccatgttcatctccatttccggttcaaaatcctgcacaatccggatttcttccccgcaatgttcgcagaacagcattccgtccttaagttcatttccacatctgggacatttcatataaaacccttcctgttactttccctgcagttttacggattccagacaattatgcatcagcatggcaattgtcatagggcccacaccgccgggtaccggggtgatggctcccgccacctgagatacatcttcaaaatccacatccccgcaaagcttattattttcgtctcgatccatgcccacatcaattaccgccgcgccgggctttacatactcacttgtaatcatcttcgcttttcccacagcaacaacaaggatatcggctctttttgccaccgctttcaaatcctgtgtccgggaatgcgctatcgtaacggtgccgttctcccgcagaagaaggatgcccataggcttgcccacaatattactgcggccgataaccacacattccttcccggcaatttcaatatccgaacgcttcagaagttcgataatccctgcaggcgtacaggatacaaatccgggctggccgatgcacagcgcgcccacgctttggggatggaatccgtccacatccttctgcggggaaatcgtgcgtataaccgcgtcttcatccatatgggaaggaagcggaagctgaaccagaataccatttacatcctctctggcattgagctcctcaaccagggcaagaagctcctcctgtgtagtttcctccggcagttcatatgccagggaacggattcccgtatactcacaggctttctttttattattcacatatacagtggatgcctggttatttcccacctgaatcaccgccagggtaaccataattccctttgcctgcaattcctccaccttctgctttacttcatccttgatcgctttggaaacggccttgccgtctattatctttgccataaagcatcgcctcctgcctgccaaaatgtgactgtttttggtgtccataccacaaatactgtttattatctcagaaaagaccggttatacgtccttcctcattcacatcaatattaaatgcggcaggcgtcttgggcaggcccggcattgtcatgaccgctccggtcagcaccaccacaaaccctgctcctgcagatacataagcctcccttacactcatttcaaagccctcaggccttccgagcagatcgggattatcagaaagagaatactgagtctttgccatacatacgggcaggccgccgaatccaagctctgtaagctttttcagctgcttctgcgccgcaggggaatataccacgccatccgctccgtaaatttcccgggataccgcattaatcttttcctcaagactcagctcatctgcatataaaacatggaaatggctttccttcttttccagagtatccagaaccttttcagccagggcgattccgccttccccgcccttttcccatacttgggaaatagcgaactcgcagcctcgttcctcacagaagctctttacatacgcgatttccgcttccgtatcagatacaaaggaatttaaggtgactaccacaggcacatcatatttctgcagattttcaatatgcttctccaggttcacaattcctttttccagcgcctcaagattttccgttcccagatccgctttggctgcccctccgttatatttcaatgccctgaccgtagccacaaggactactgcatcgggtttcagcccggacatcctgcatttgatgtcaaaaaacttttcagctcccagatcggcgccgaatccggcctccgtaatcacataatcagccattttaagggccgctttcgtagccctgaccgaattacagccatgtgcaatattggcaaaagggcctccatgtactatggcaggggtatgctccagcgtctggatcaggttgggcttcagggcatccttaagcagggctgccatagaacctacggcatggatatctcccgcagtaaccggccttccgtcaaaggtataggcaactaccatacgggaaagacgttccttcagatcatccatatcttccgccagacacagaacggccataatttccgtagctaccgtaatgacaaaatgatcctctctcaccgtgccgtccattttgctgccaaggccgaccacaacattacgcagaaccctgtcattcatatccaggcatcttttccagaccacctgtctggtgtcaattcctaattcgtttccctgttgaatatgattatcaagaagagccgcgcataaattattggcagaagtgattgcatggaaatccccggtaaaatgaagattcagatcctccatgggaactacctgggcgtatccgccgcccgcagctcctcccttaatcccaaagcaggggcctaaagacggctcacgcagagctatcacggctttttttcccaacttgccgaaggcctcgcccagccctacactggtagtcgtttttccttcccctgcaggagtgggattaatcgcagttacaagaaccagcttgccattcggcctgtcctgtatactgtctatgaattcatcggaaatcttggccttatactttccgtagagttccagatcatcctcctttatccccagcttttccgcaacccgcactatgggctccataaccgcttcctgtgcaatttcaatatccgtcttcattcgtttcctcctaagcttaaagagattcctctatgtattgttcaaactgctccggactcatcaatacttttctgggcttggtgccttcctcttctcctaccacgccggcttcagccagctgatccatgatgcgcgccgcacggttaaacccgattttaaacactctctgcagcatcccgatagaagccttgtccttgtcgataataaacttcccggcttcttcaaagtaggcatccctttccggtccgcccccaccggaagcaccgccggcacctcctcctgcggattccatggttttcaccttctctacgatctgatcatcatagacattcccgataacctggtttttcaggaaatcaaccacatcggagacttccccgtccgaaacaaaagctccctgtattcttgcgggtttggaatagccctggggataaaagagcatatcaccctttcccaaaagcttttcagcaccgttcatatccaatatggtcctggaatccacgccgctggatacggcaaacgccacacggctcggcatattagccttaatcaggcctgtaataacatccaccgacggacgctgtgttgctatgatcagatggattccggcagctcttgcaagctgtgccagacggcagatggattcctccacctcaccaggggaaaccatcatcaaatcagccagctcgtccacaataataacgatctggggaagcttgtcaggcgccgtcggatcccctttcgccctctgctcttccacctttttattgtagcccttcaaatccctgacgttgtgatccgcaaacttctgatagcgatccgtcatttcggccacaccccagtgcagagcggccgacgcctgcttgggatccgtaaccacgggaatcagcagatgaggaataccgttataaacactcagttccaccaccttcgggtcaaccaggatcagctttacctcatcgggcctggctttatataaaatactcataatcagggtattgatacagacagatttaccggaaccggtagaaccggctatcagcatatggggcattttggcaatatccgataccactacctttcctccgatatccttgccgactgcaaaagacagcttggaagggaaatcacagaactccttgctctccatcagttccctgagggctaccatggtgttttccttgttgggaacttcaatgccgattgctgcttttccgggaataggggcttcaatacgaatatccatagcggcaagattcagcttgatatcatctgcgagtcctaatatcttgctcacctttacaccctgttccggctgcagctcataccgggtgaccgaaggaccctggctgatatccgtaatcgtcacctttacgccaaaggtagccagtgtctgctgcagcttagccgccgtattttttaattccttaacaccgtctcccgtatttttgcttcccggtttttgaagaaggctgaggggagggaaatgatagggcctttcctttttaggagcctccgtatgagtaactgcggcagcgccttccttgcgcatttcatccattgccgcctgccctgcaggcttaccggtatcatacacacccggagctttcccccctgcaaaacgatctcttccttccggcagacttgctttgggccgttccataccggcggcaggcgccatggcttcctgcagaagaggttccccggaatccggttcttcccagggaaggatttcctgctccggcacctgatcatacaattccccgccggcaggttcttctttgtcaggcagctgcgcgtcaaaaatcgtactgcgcgcctcacccgcaggcttgacggttatatgtatgggtgaaacctccttcatatcgctgaacacatcggaattccgataggtctgcgcgagaggatccggctccggcgctgtttccgccggcataccttctccgaatttatcattttcctccagagtcatctgtgaagccgtatgtatctgtattcggtcaaaatcgatgatattgtctgccttgggagccactttgacagcttccttcttttccgcagccaaatcctctactgtaatctcatgaatatcatttctcgtacgagccggcaattcttccaccgggccgccgttctgtcctgccagtgtggtatctatcatgacaccggaaactctcttgtccatccgaaggattttttccgcatccttcctggctttttcttcttctctgagccggtattcctcttctcttctggcttccagctcttctttccttttctgtgccctttccttccggactctcgtttcttcccgggctgattcgtaaaccttgcgcccgccgaccctgactccgcttacaaaggatttttccgttataaccaccaggcaaatgattgcaagcacaataacaaggagcaccgcgccgaccattcccatgaaatgattgagcagataagcgagagacccggccagaacgccgccgcccgccttggaatccgcgcttacggtatacaaaagctccacggagtatttttccatggagggaacctgtccgccaataagctccagaaccacaccgattaaaagtatcaaaagaacagccgccgcaattttaaatgcagcgaacatattccccttattggaaattccaaaagcaatacccagaaaaataagaacggggaccacataagccatcatgccgaaaataccgaacatcacatggctgacggcattgccgacgggaccgataataccaaaattacataaaaagagcagaatacttaacgcaaatacaccaatcagaataatctcattggtgattgcgctttcttcttctgttcgtattgtctgctgacttctgctctttgaatttgtcttactggttttgctcttattattggaactgcttctcgttctggaagaagatgaagtattctttttacccgcgcctgacctgcttcctgaagttgatgccattttaaaccgcctccaaaatctgtaaaactacagactaaatctaaattagtataccacgaaatagttcccttgtcatccttaaatatttcagccctccgccagttcgtggagtttggcgattgcttccttaatacctcccacctcattgattatgcctgttttcacagcttcttcccctaccagaatcgttcccagatccttggtgagcactccggtttccatcatcagctcttccatccgttctctggtgatatcacagtgggaacatacaaagccggttatcctgtcctgtatctgcttaaaataatcgaaggtctgcggagccccgataaccgtgccgttcatacgcaccggatgtatcaccatggttcctgacggaacgataaaagaataatccgcgcttactgcaatcggcacgccgatggaatggccgcctcccagaaccagggatacggtgggcttgctcagggatgcaatcatttcagcgatcgcaagccccgcttccacatcaccgcccatggtattcagaagtaccagcaggccttctatctggctgctgtcctcaatggcggccagctggggaaggatatgctcatatttggtcgtttttgaggaacttcccaaattgtcatgtccttcaatctcaccgataatggttatcatatgaatggctttttcatcttccccgtgcttttccagggtaagctggccggtctgctcgattctctcatctctctgcttttcttcttctgcttttttgctgctcataatatctgctcctgtcctgcggaaacaatggattctgcctgtttcaggccatcctgctgtttatatatggagaaatactgtccgcatgttttttgatattgtctgcaaagggaacagattttattctgaaaaatgatgccgccatgcgccggccgaaggcaaaaaagcggcaggaattgcttcctgccggatattttatcctgttgctgccgtatttaaagcagatcgaaatcatccttctcatccagattttctatatcaaaacacatctcctgctcatccggttcgaaggcataatccatttctctgggaacgtgttttttggggccgggaagaggattggggatcggttctcccggctgaggcacaggcagcggcgctgtttccgcagcttcctcctgccgtaccggctcctgcggtatcatgtctgcagcatttactttttgttttttctttttttcttcattaaaacagcacatactatgaactcccattcctgcaaataccccccagaaaaggagggttattgtctgtttttccattgaggtcccaaacagcagatcactcaccagaagaaagacaaaaggtatgatccagataattcccaggtttcccttttgttcaaaaaaaccaaacacataaaaaaaagcaaaaaacagcagcggcaggaaataaaacagctcttcctgattcgcaaagcttccccatcctatgtactgggaaaccatgtttcttgaaaaccagtcctgcataagcattccggcctctccgccgaataaaaagagctgaagacccagtgccgccccaaagccgcatgcgccagccgccaaaaatactgccgcttcccgcagcgccgttcctctgcgtgatgacctgcgttccagatacaggatacccagaaatcccagaaaaaacaggctcaggaaaaaataatccataaaagataaaaatcctgctgcaattcctgtcagaaaaacaaaaagcccggaagaagccgattttttaccgctttttctcaatttacgaagcagcagccctattaacagcagtgcgagggcaaaaaaaagcatccgcaggctttcaggggtcgccgccagacaatattccacataaacaggaagcaatgcggcggccgtaactgcggcaactgccacaattctgcctgcaatcatgcgtatcgcgggatataagactgcaatagcagctatctggagtccgatctgaagaagaatacaggtattttcccatactcccagccgggaaaacaatccggtaagcagatacagaaaaacagcccggaaattgattccctccaatccattatgtccgccggccgcagccgccgcaagttcataaagagatttgtcgccaaacagctccgctccgcctgctgacgccatccagagcctgagagccagtgctgccgctatcgcaaagataagaaacaggcattcccaaagctgggcatgccgtgccccttcctgaacataagaacggcgcggagagcgcggcatacattgtttttcccggtttttcatcccggccagcgtacgtatgggcagatataccagaagaatgagcagaaacgcacagcctgccgtgccgaggaaatagaacatccagccaaggcccagcatggagcagacaagcgaagtctgtacggtaaaatatatacagataacaaggccgtataccgcccacaatatataattaactctgtatctgctatacctcatcatacccccatatatccggccttcagatagcagccagcgcctgttccaaatccgctatgatatcatccgcattttcaattcccacggaaaaacgaatgagatccgggttcacacccgcttccctgagctgttcatcattcatctgtctgtgggtatggcttgccggatgaagcacacaggtccttgcatccgccacatgagtcacgatggcggcaagctccagcttatccatcattacctcagcggcattccttccgccctttaaaccaaaggaaatgaccccgcaggtaccattaggcatgattctctgtgccagttcataatatttactgctctttaagccgggataatttacccacgcaaccttatcatgattttccagataggtcgcaactttcaaagcgttctcacaatgccggggcatccttaaatgaagggtttccagtcccacgttcagcaaaaatgcattctggggagattggatggaacccagatccctcatcagctgtgccgtagccttggtgatataagcttttttaccgaatctttccgtgtatactacgccatgataggaatcatccggctgacataatccggggtatttatcgggatacaggctccagtcaaaattaccggaatccacgatagcacctcccacacacatggcatggccgtccatatacttcgtagtggagtgcgtgacaatgtctgctccccactgaaaaggattgcagttaataggggtggcaaaggtattgtccacaatgaggggcacctgatgagcatgggccgccttcgcaaatttttcgatatccagcaccaccagggccggattggctatcgtttccgccagaacacatttggtattatcctgaaacgcttcgcacagagtatcgtaatccgaatccggatccactatggtacaggaaatgcccatttttttcatggtcactgcgatgaggttaaaggttcctccatacacagtcgatgaaaggacaatatgatcccccgcctcacagatattaaatacggcataatagttagccgcctgtccggatgaggtgagcatggcagccaccccgccctccagttcacagatcttctgggcgacgcagtcgttggtgggattctgaagccttgtgtagaaatagccttcttcttccagatcaaacagacgtcccatctgctcggaggtttcatatttgtaagtggtgctctgataaatgggaagaacacggggttctccattacccggcttccagccggactggatacatattgtttctttggtataaggttttttcatttgccgctcccttggggaattattcatcccagttatgatatactgcctgtacgtcatcttcagcatccagcagatccagcgtacggttcagattcttaattgccgtttcgtcagtaagctccacataattctggggaatcatggtcacctctgcacttgccattgcgattcccgcttcttcaagcgctttctgtacagtctccagatcatcgggcgccgtcaggatttcaaagctgtcctcttcttccgaaaagtcttctgccccggcatccagcgcagtcatcatcaggtcatcagcttccatatcgcattcttctttgtcaataataatctgtcctcttttatcaaacatgaaggatacacagcccggagttcctatgcttccgtttcctttggtaaacgcgcttctcacattggcggcggtacggtttttattatccgtaagagcgtcaacgataatcgcgataccattgggaccgtagccttcataggttacatattcgtaattcacatttcccatatccccggcggcctttttaatgccgcggtcaatggtatcattgggcatattgttggccttcgcctttgcgattacctgggcaagcttgaaattattgctcggatccgatccgccttcctttacggcaactgcaatttccctgccgaggatggtgaaaatctttcccttagccgcatcatttctctcttttttgtgtttaatattagcaaattttgaatgtcctgacatcttttctttctccttttatctgcttggttccattaactttaccacatgctgcttttcagccggccgtttcctggccggaagaatacatttcatcttctctgccggatacagacctgccgttttcatcaaaagattcttcttctggaagttttttgaccagaacagtcttaatcatcttattctctacggaaagtacccggaattcataaccgcctaaacggatatcaaatttttcatccggttccggaatgtgttccattttggctataataaatccgttcaatgtctcgaattcgctctcatcaaaggaaatgtccaaaagttcctccaaatcatccagaggcgttttgccttcgataatatattcgtccttgcacttttcgcggatataggactcatccacgtcatattcatccagaatattgcctacaatttcttccagtatatcttccatcgctatcatgcctgcggtctgtccgtattcgtccagtacgataaccatctggcatttggtggactgcatggtcttgaaaagcgcatccaccttccgggtttccggtatgaacctggcttcacgcaaaagcccgggaatatcccttattttcatttccggatcggtttgcgcctgtctgcgcagagcatccttcatatgaagaatgccgataatatgatcgatattctcttcatatacaggatatctgctgttgcggccgttaagcatgaattccaccgcatcgcggaaggtactctcacagtcaatcgccacgatattcgtacggttggtcatgatatcctccgcacgtttatccccgaactcaaaaatattggttatcatctccgcttcactggcctggatcacaccctgctcatgcccctcatttaccatggatatgatttcttcttccgttacatccatgctgtcctcgtccggatgcatgccaaacagcttcaggattccatgggccgttacggcaaaaagccctgtgaggggaataaaaagcgatatgactgcggaaaccggcctgaccatacagtaggcccatttttccggtgaccgggcagccatctttttaggtatgagtatccccaataccagcaatatgtaaagcagaagaatcatcgtgaggatgagggatgccactgtgataagccctccggcaaaaggcgaaaggccgccctctctgcccgcaagctcctgaagcatcctgcgtatatgcacgctccaaacccgcagatatacgccgcccatacaaagattcagaaacgtaaccacaagctggaccgtatttacataccggttcggattttccagaatcctgcttaaaagaagggatttcttatccccctcctcaatcgcttttctttctacttctttttcattcagtccatgaatcgcagcgccaaagccatagcataaggcttctatgagcaaaagcgccaaaaataaaggtatactggcagtaggcccaccatcgtccattctatcaactcctttttcaaggcggtgcacacactgacgtgcgtacaccgccttactctccttaatatatcatctcggtaaaaaaacgtcaagaaaccacgcttagcttatgtatttaattccagactgaccttcaatgcctggtttactctggccatggtgggttcatccaaatgacagactctgtccttcagcctctgcttatcaattgtcctcagctgttccagcaggatgacagaatcctttacaatatcatactgtcccgcacgcagttctatatgggtcggaagcttcgctttattcatttttgaagtgattgccgcgcaaatcacagtagggctgtgtttgtttcccacatcgttctgtataatcaataccggcctgatcccaccctgctccgaaccaatcaccggccttaaatctgcgtaataaatatctccgcgtctcattttcctgacactccttcttctttccttatggcagcatctgcaattcactgccttgcaatattattgcccttttttcggaaggtattcaggttaggtgattttcagcggaaatcccggaaggaatccttactatatacgactttaccgtccctcgtataaattctgggtactctcttgttcagacagcaggccagctcataattaaaacggccggaaagctctcccagctcttccatggttatgctttcttctccgtcccggccgatgagcgttacctcatcgccctgcgaggcttccggtatcagggatacatcgaccataaactgatccatacataccctgccgagaatcggcgcctttttgccatgaatcagcacatagcccttattggaaaggcttctgggataaccatccccataccccaccggtatagtggctacctgcatggtctctttggcgacaaacgttcccccatagctgacttccatgccggcttccagcttttttatgtatacgatacggcttttcagggacagaaccggctgaagggaaataatatcccttttcacctcatcggagggccacagtccgtacagcgtgattcccgccctgacagcatccagatttgcatcctttaattccacaattcccgcgctgttggaacaatgccgtaccggaatgcggattcccagctgatcatgaatctgccctgtaaaggcaagaaaagattccagctgtttttttgccgaagttttatctttctcatccgctttggcaaaatgggtgaatatcccctcaatttccactccgggagtttccgcacatttttttacaaaagaaaggccgctttcatccggacggattccgattcggctcatgccggtatccacttttatatgtattttgacaggcctgccgcatgcctggcctgcctttcccatttcttccagcatatcctcccggaatactgtgggccggatttcttcccgggccatcttctcgtagcaataaggaaaagtatagccaagcaccagtaccggcttgcgtattccgcttcccttaagaatcagggcctcttccacggtagcaacggcaaaaccgtgaaggaaaggcatatcctcgatttcatgggcaataggaaccgcgccgtggccatagccatccgttttcactacagccataatcttggaatcttccctgatattatttttcatttgtaccatattatacttcactgcatccaaatctacagttgcccataccctgtcatagtttttcataattcagctccctctgcatattattctgcatccctataaaccgcgaaacagcaaattcttctgctgtatctcattcacccctcttcggcatgagatgatccagttcgtctatcagcgctcctgccgtcacaccatactcgcttttcttatgtgccgcaccgtccccggcgcagccatgcagataaacaccggcacatgccgccgaaaaagcatccattccctgagccagcaatcctgccagtattcccgtcagtacatcaccgctgcctgccgttgccataccgctgttgccggtcatgttcagataaagcttcccgtccgggcttcccacaagagttctggctcccttgcaaatcatggcagcctgcagtttttccgcccattcccgggtcaggggtatggcgtctctctgtatttcagggatctttttccccgccagccggccgaattccccgggatgcggagtcagaatcagttccctccgcctttcgggatcctgctgcatttctataagcttttccagcagttctttctgtccggccagaatattaagggcatccgcatccatcacaatcggcccccttgaatgttccaccaccatttccagcagcttcagcgccatattgctttggccaagtccggggccgacggctgttatatccgcccaggaaaaaacatgcagaagctctttttcaaaggcttccgaccattgttcataggcggttatcatagcctccggcaatgcagtctgcaaaataacccgattgccttcgtccgttaccacccgtatcatccctgcccctgtatgtaatactgccgacgcagaaagctgacaggccccggccattccccggcttcctgcaagcagagccacctttccgaaggtacctttatttccgtcctccggcctcggcggcagcaaggcagcttctcctttcggcagggtaaatacccggggataatcccccagaaagctctcccccgtaatcccgatatctgcgcataccactttccctgcataccgtgcgcccggataaaaaacaagtcccagcttcctgtatgcaaaagtcaccgttatatccgcctgcaccgcacagcccataaccgcccctgtgtcgctgtttataccggacgggatatctacggaaaggacataagcgtcctgtcggttaataaaatccaccgcatccgcaaatttcccttccaccggtctggtaagcccgattccgaaaagagcgtctatgattatatcatattccttttccggaagtttgcgcatgacccgctgcccgtaacgttccagaattgccagctgtgctgaggtctcctccgtgagatgctttgcttcctcatttccaatcagacagtaatccacagaaaaaccggcctggtacagaagccttccgacagccagtccgtctcccccattatttcctgttcccgaaaccaccagcgtccttctgcccggatgcaccggatcgaaaggacgtagtgcctcctgcagctgtctatccctctctttcagctcctgtacgcaggccagagccgcccgttccatcaataccatggaagacatgccaaaatgctttattgtattcccgtcgcatcttttcatttccgcagctgtcaccagatattccattttcgcttcctttcctgctggacagttcctgaaaacctttacaagtaacaacgttttcaggcgccgcatttcctttcgcgcaaaaatgcgtcaggagtgaaatactctgacgcattttacagcctttattcttcctcacctatatcatgttctttttcatactggttaatcatgtaagacagcttaatcaggctgtccgacagatgtacattttcaacctgaacactgtccggcacgtccaaatccacatgggcaaaattccatatagccttgattcccatacctaccagcttttccgcagtagccaccgcgctttccttaggtatggtaagaacggcaatatcgatattattgtccttgacgaattcctgcatttcctccatcggacgaaccttcatcccccggatcattttaccatgaagcttttcattaatatcaaagattcctgtaaaaataaatcccctgcgttcaaagttcatataattcgccagagcctgtcccaggttgcccgctccgataattatcaagtgatgttttttatccagtccgagtatcttgccgatttccgagtacagatactccacattatagccatagccctgctgtccgaagccgccgaaattattaaagtcctgacgtatctgggatgcggtcacgtgcatgagcctgctcagctcctgagaggaaatacgctccacaccgctgtccttcaattcaccaaggtacctgaaatatctgggaagacgtgctattactgcc
